US009655976B2

(12) United States Patent
Tellers et al.

(10) Patent No.: US 9,655,976 B2
(45) Date of Patent: *May 23, 2017

(54) TETRAGALNAC AND PEPTIDE CONTAINING CONJUGATES AND METHODS FOR DELIVERY OF OLIGONUCLEOTIDES

(71) Applicant: Sirna Therapeutics, Inc., Cambridge, MA (US)

(72) Inventors: David Tellers, West Point, PA (US); Steven L. Colletti, West Point, PA (US); Vadim Dudkin, West Point, PA (US); Jeffrey Aaronson, West Point, PA (US); Aaron Momose, West Point, PA (US); Thomas Joseph Tucker, West Point, PA (US); Yu Yuan, Orlando, FL (US); Kathleen B. Calati, Rahway, NJ (US); Lu Tian, Jamison, PA (US); Rubina G. Parmar, West Point, PA (US); Anthony W. Shaw, West Point, PA (US); Weimin Wang, West Point, PA (US); Rachel Anne Storr, West Point, PA (US); Marina Busuek, West Point, PA (US); Robert A. Kowtoniuk, West Point, PA (US)

(73) Assignee: Sirna Therapeutics, Inc., Cambridge, MA (US)

( * ) Notice: Subject to any disclaimer, the term of this patent is extended or adjusted under 35 U.S.C. 154(b) by 95 days.

This patent is subject to a terminal disclaimer.

(21) Appl. No.: 14/398,369

(22) PCT Filed: May 1, 2013

(86) PCT No.: PCT/US2013/039072
§ 371 (c)(1),
(2) Date: Oct. 31, 2014

(87) PCT Pub. No.: WO2013/166155
PCT Pub. Date: Nov. 7, 2013

(65) Prior Publication Data
US 2015/0246133 A1   Sep. 3, 2015

Related U.S. Application Data

(60) Provisional application No. 61/641,741, filed on May 2, 2012.

(51) Int. Cl.
| | |
|---|---|
| *C12N 15/113* | (2010.01) |
| *C07H 15/203* | (2006.01) |
| *A61K 47/48* | (2006.01) |
| *A61K 31/713* | (2006.01) |
| *C07H 15/26* | (2006.01) |
| *A61K 31/7056* | (2006.01) |

(52) U.S. Cl.
CPC .... *A61K 47/48092* (2013.01); *A61K 31/7056* (2013.01); *A61K 31/713* (2013.01); *C07H 15/26* (2013.01); *C12N 15/113* (2013.01); *C12N 2310/17* (2013.01); *C12N 2310/3513* (2013.01)

(58) Field of Classification Search
None
See application file for complete search history.

(56) References Cited

U.S. PATENT DOCUMENTS

2009/0124571 A1    5/2009   Morvan et al.

FOREIGN PATENT DOCUMENTS

| WO | 2005100584 A2 | 10/2005 |
| WO | 2011126974 A1 | 10/2011 |

OTHER PUBLICATIONS

Deniaud et al. "Insights in the rational design of synthetic multivalent glycoconjugates as lectin ligands," Org. Biomol. Chem. 9: 966-979 (2011).

*Primary Examiner* — Richard Schnizer
(74) *Attorney, Agent, or Firm* — Jeffrey N. Townes; LeClairRyan

(57) ABSTRACT

Disclosed herein is a modular composition comprising 1) an oligonucleotide; 2) one or more tetraGalNAc ligands of Formula (I), which may be the same or different; optionally, 3) one or more linkers, which may be the same or different; 4) one or more peptides independently selected from Table 3, which may be the same or different; and optionally, 5) one or more targeting ligands, solubilizing agents, pharmacokinetics enhancing agents, lipids, and/or masking agents.

35 Claims, 200 Drawing Sheets

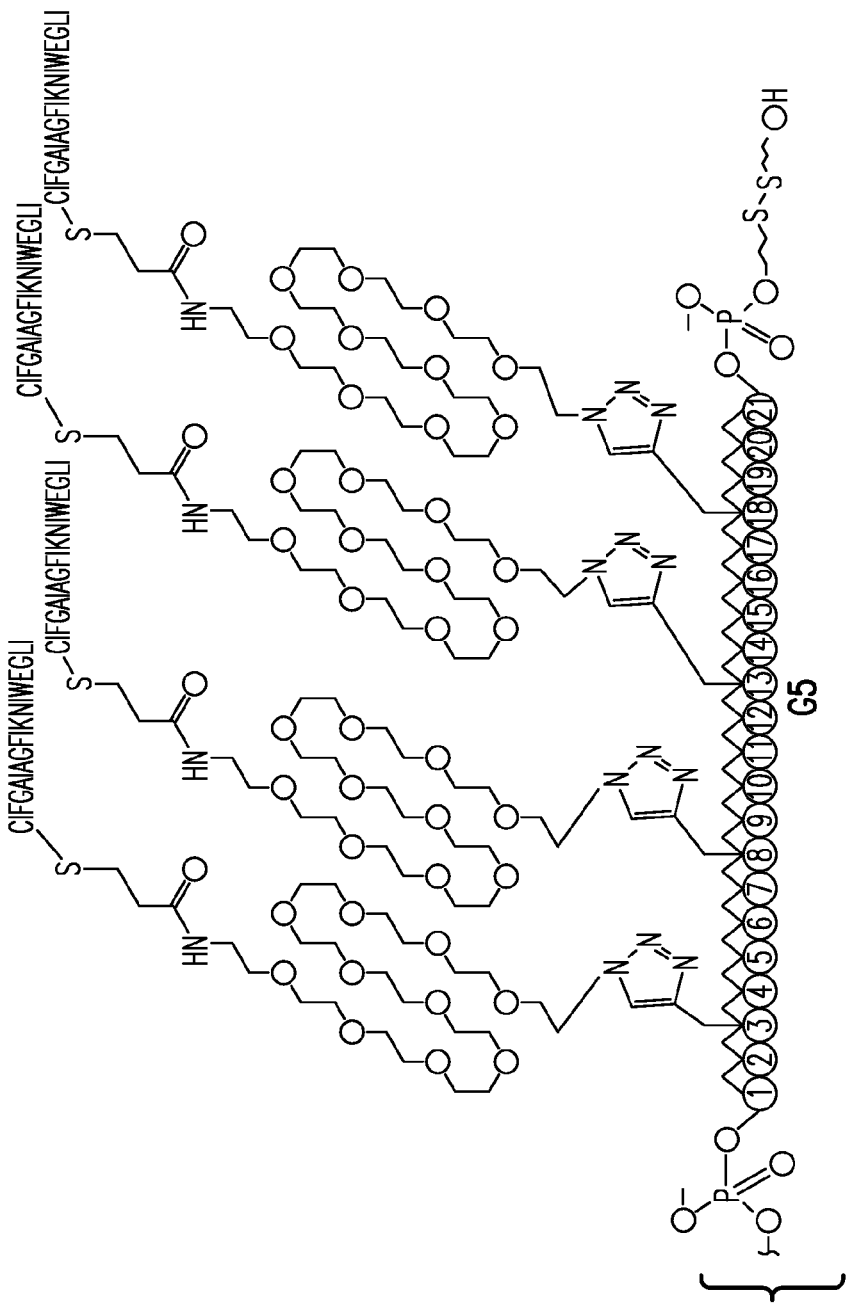
FIG.17D-2
continued from Fig.17D-1

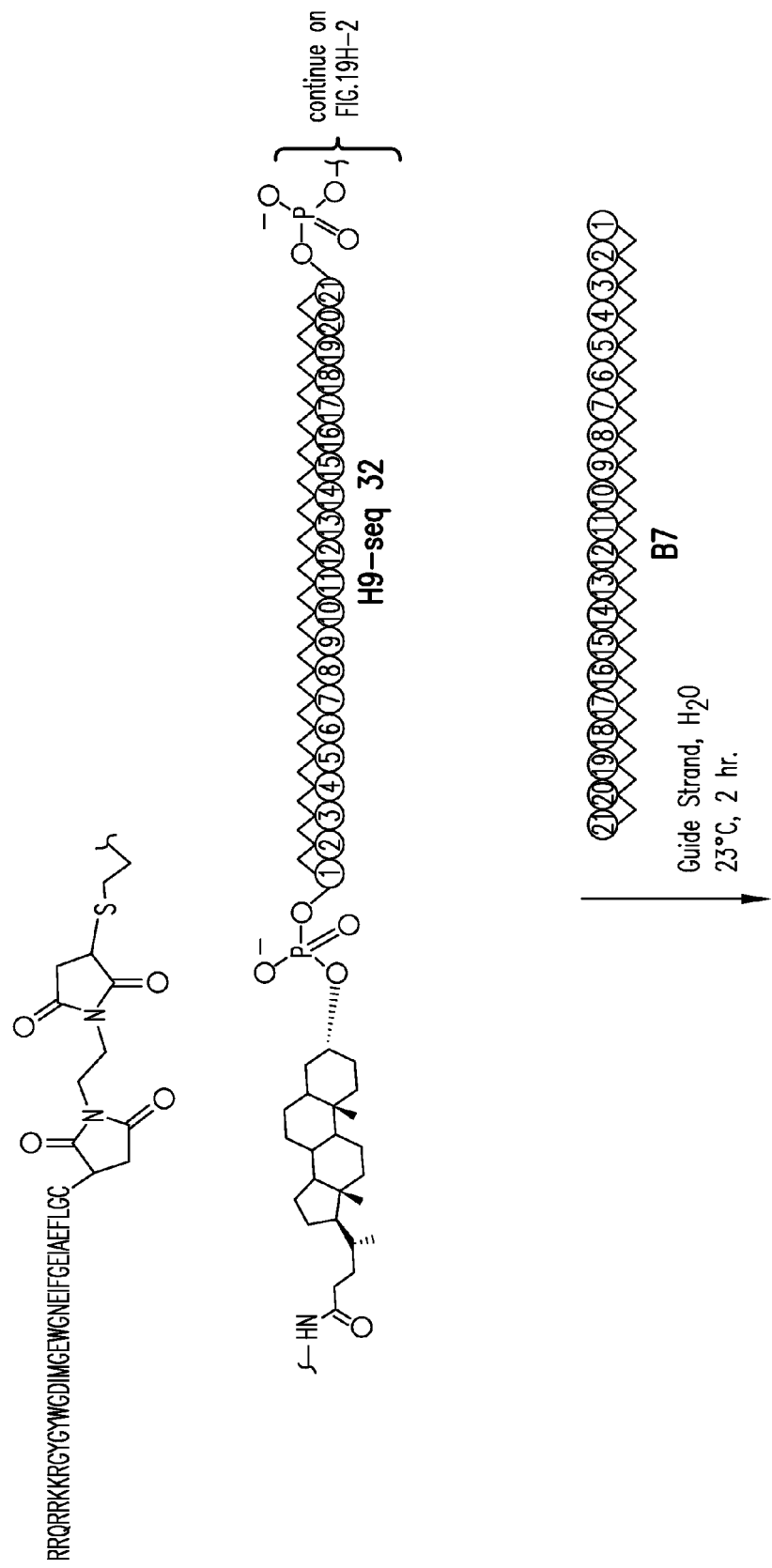

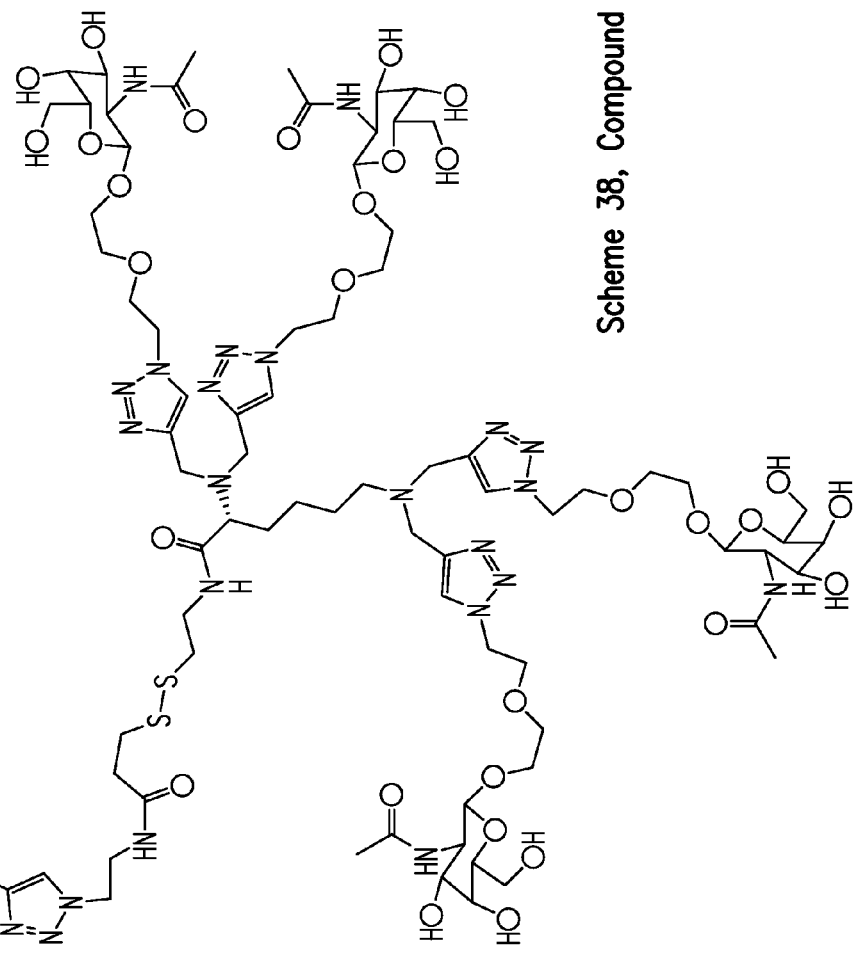

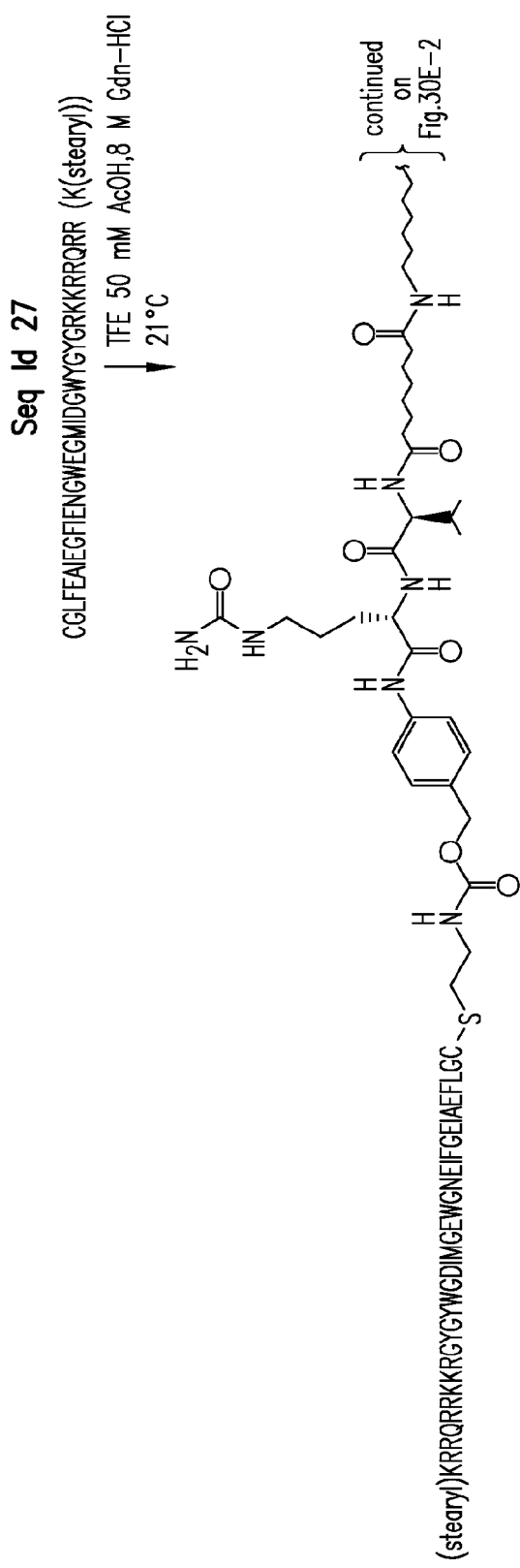

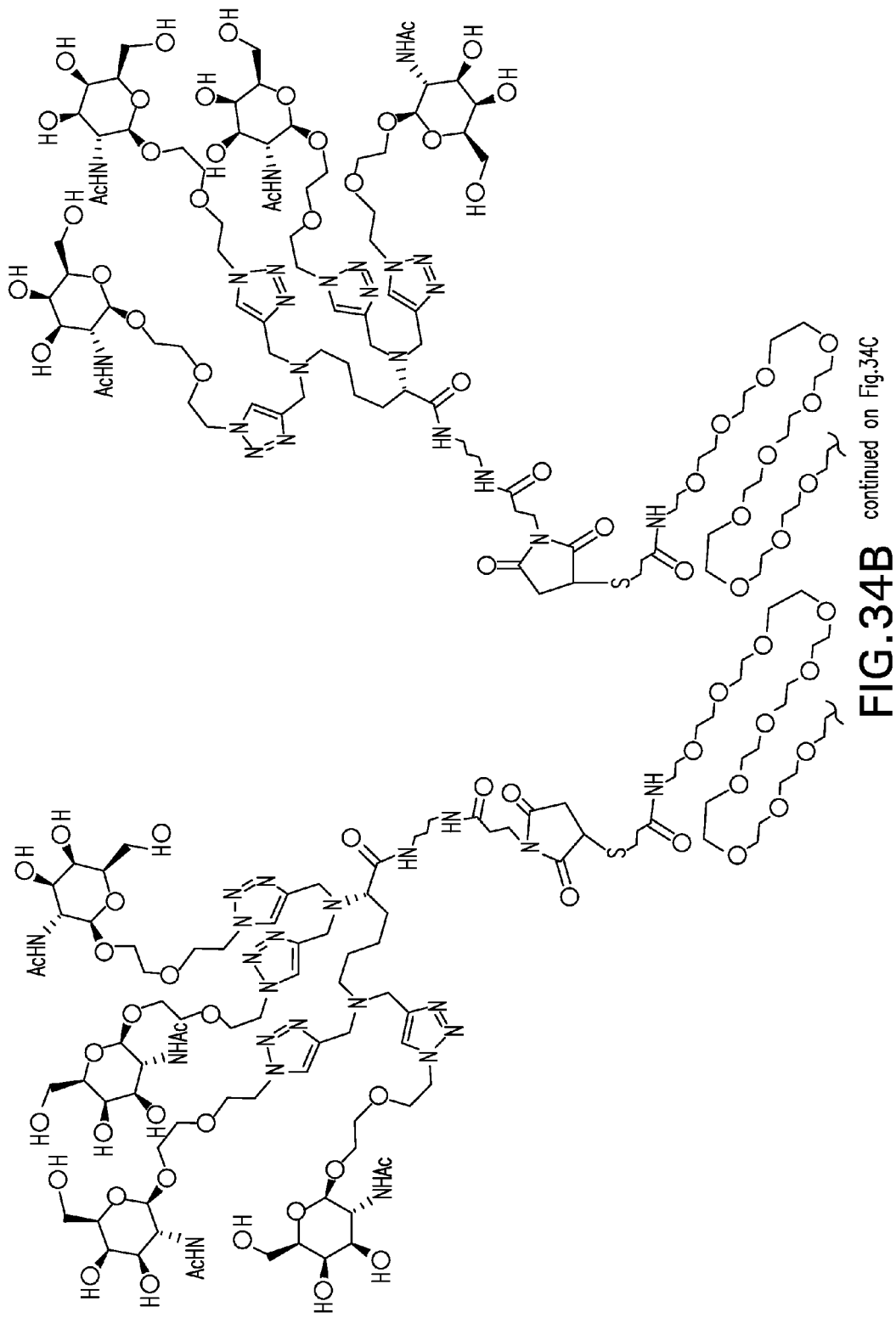
FIG. 34B continued on Fig. 34C

TETRAGALNAC AND PEPTIDE CONTAINING CONJUGATES AND METHODS FOR DELIVERY OF OLIGONUCLEOTIDES

CROSS-REFERENCE TO RELATED APPLICATIONS

This application is a national-stage application of PCT Application No. PCT/US2013/039072, filed on May 1, 2013, which claims the benefit of priority to U.S. Provisional Patent Application Ser. No. 61/641,741, filed May 2, 2012, both of which are incorporated by reference herein in their entirety.

BACKGROUND OF THE INVENTION

Scientific efforts focused on the delivery of oligonucleotides systemically for therapeutic purposes are ongoing. Three highlighted approaches to oligonucleotide delivery include 1) lipid nanoparticle (LNP) encapsulation, 2) polymer conjugation and 3) single chemical conjugation. Single chemical conjugation typically employs a targeting ligand or a lipid or a solubilizing group or an endosomolytic peptide or a cell penetrating peptide and/or a combination of two or all four attached to an oligonucleotide. Linkers may be present in the conjugate as well as other functionalities. Single chemical conjugates are known and attachment of the oligonucleotide occurs either at the 5'- or 3'-end of the oligonucleotide, at both ends, or internally. See WO2005/041859, WO2008/036825, and WO2009/126933.

Considerable amount of literature evidence supports the hypothesis that the major hurdles for oligonucleotide delivery are cell uptake and endosomal escape. There remains a need for additional single chemical conjugates that can provide effective delivery efficiency, cell uptake and/or endosomal escape.

SUMMARY OF THE INVENTION

Single chemical conjugates comprising tetraGalNAc and peptides disclosed herein have surprising properties of effective delivery efficiency, cell uptake and/or endosomal escape.

In one embodiment, a modular composition disclosed herein comprises: 1) a single stranded or double stranded oligonucleotide; 2) one or more tetraGalNAc ligands of Formula (I), (II) or (III), which may be the same or different:

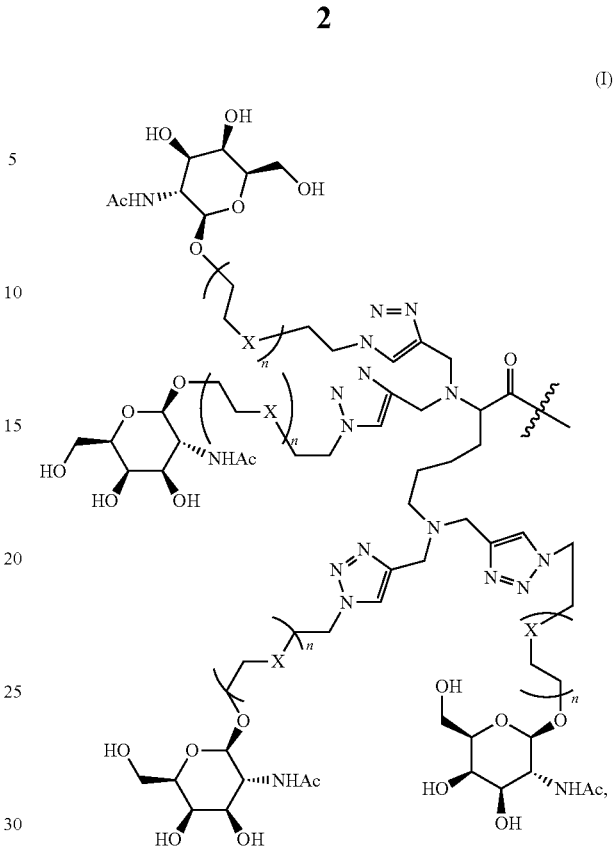

(I)

wherein X is —O—, —S—, —CR$^1$R$^2$— or —NR$^1$—, wherein R$^1$ and R$^2$ are each independently selected from the group consisting of hydrogen and C1-C6alkyl; n is 1, 2, 3, or 4; and the bond with "⁓" indicates point of attachment; optionally, 3) one or more linkers, which may be the same or different; 4) one or more peptides independently selected from Table 3, which may be the same or different; and optionally, 5) one or more targeting ligands, solubilizing agents, pharmacokinetics enhancing agents, lipids, and/or masking agents. In one embodiment, R$^1$ and R$^2$ are each independently selected from the group consisting of hydrogen, methyl and ethyl. In another embodiment, R$^1$ and R$^2$ are each hydrogen.

In one embodiment, the tetraGalNAc ligand has Formula (II) wherein X, R$^1$, R$^2$ and n are as defined above. In another embodiment, the tetraGalNAc ligand has Formula (III) wherein X, R$^1$, R$^2$ and n are as defined above:

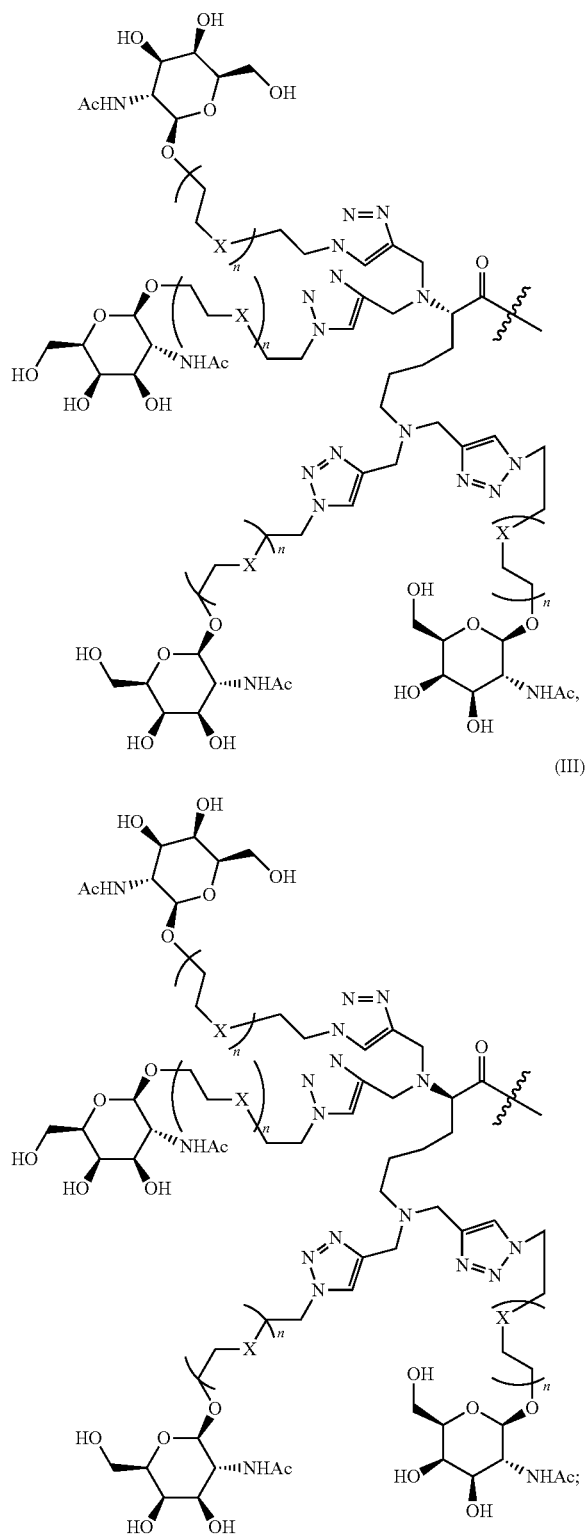

In another embodiment, a modular composition comprises: 1) a single stranded or double stranded oligonucleotide; 2) 1-8 tetraGalNAc ligands of Formula (I), (II) or (III), which may be the same or different, wherein X is —O—, —S—, —CH$_2$— or —NH—; and n is 1, 2, 3, or 4; 3) 1-24 linkers, which may be the same or different; 4) 1-8 peptides independently selected from Table 3, which may be the same or different; and optionally, 5) 1-8 targeting ligands, solubilizing agents, pharmacokinetics enhancing agents, lipids, and/or masking agents. the tetraGalNAc ligand has Formula (II) wherein X, $R^1$, $R^2$ and n are as defined above.

In another embodiment, a modular composition comprises: 1) a single stranded or double stranded siRNA; 2) 1-8 tetraGalNAc ligands of Formula (I), (II) or (III), which may be the same or different, wherein X is —O—, —S—, —CH$_2$— or —NH—; and n is 1, 2, 3, or 4; 3) 1-24 linkers, which may be the same or different; 4) 1-8 peptides independently selected from Table 3, which may be the same or different; and optionally, 5) 1-8 targeting ligands, solubilizing agents, pharmacokinetics enhancing agents, lipids, and/or masking agents.

In another subset of the above embodiments, the linkers are attached to the oligonucleotide or siRNA at different 2'-positions of the ribose rings and/or at different terminal 3' and/or 5'-positions of the oligonucleotide or siRNA.

In another subset of the above embodiments, the tetraGalNAc ligands and/or the peptides are attached to the oligonucleotide or siRNA optionally via linkers.

In another subset of the above embodiments, the tetraGalNAc ligands and/or the peptides are attached to the oligonucleotide or siRNA at different 2'-positions of the ribose rings and/or at different terminal 3' and/or 5'-positions of the oligonucleotide or siRNA; and the tetraGalNAc ligands and/or the peptides are attached to the oligonucleotide or siRNA optionally via linkers.

In another subset of the above embodiments, X of Formula (I), (II) or (III) is —O—, —S—, or —CH—; and n is 1, 2 or 3.

In another subset of the above embodiments, X of Formula (I), (II) or (III) is —O— or —CH$_2$— and n is 1 or 2.

In another subset of the above embodiments, X of Formula (I), (II) or (III) is —O— and n is 1 or 2.

In another subset of the above embodiments, X of Formula (I), (II) or (III) is —CH$_2$— and n is 1 or 2.

In another subset of the above embodiments, the composition comprises 1-6 tetraGalNAc ligands, or more specifically, 1-4 tetraGalNAc ligands, which may be the same or different.

In another subset of the above embodiments, the composition comprises 1-6, peptides, or more specifically, 1-4 peptides, which may be the same or different.

In another subset of the above embodiments, the oligonucleotide or siRNA is double stranded; and the tetraGalNAc ligands are attached to the guide strand or the passenger strand of the oligonucleotide or siRNA at different 2'-positions of the ribose rings.

In another subset of the above embodiments, the oligonucleotide or siRNA is double stranded; and the tetraGalNAc ligands are attached to the guide strand or the passenger strand of the oligonucleotide or siRNA at different terminal 3' and/or 5'-positions.

In another subset of the above embodiments, the oligonucleotide or siRNA is double stranded; and the tetraGalNAc ligands are attached to both the guide strand and the passenger strand of the oligonucleotide or siRNA at different 2'-positions of the ribose rings and/or at different terminal 3' and/or 5'-positions.

In another subset of the above embodiments, the oligonucleotide or siRNA is double stranded; and the peptides are attached to the guide strand or the passenger strand of the oligonucleotide or siRNA at different 2'-positions of the ribose rings of the siRNA.

In another subset of the above embodiments, the oligonucleotide or siRNA is double stranded; and the peptides are attached to the guide strand or the passenger strand of the oligonucleotide or siRNA at different terminal 3' and/or 5'-positions.

In another subset of the above embodiments, the oligonucleotide or siRNA is double stranded; and the peptides are attached to both the guide strand and the passenger strand of the oligonucleotide or siRNA at different 2'-positions of the ribose rings and/or at different terminal 3' and/or 5'-positions.

In another subset of the above embodiments, the tetraGalNAc ligands and the peptides are attached to the same strand of the oligonucleotide or siRNA.

In another subset of the above embodiments, the tetraGalNAc ligands and the peptides are attached to different strands of the oligonucleotide or siRNA.

In another subset of the above embodiments, the tetraGalNAc ligands and the peptides are attached to the same or different strands of the oligonucleotide or siRNA via linkers.

In another subset of the above embodiments, each linker is independently selected from Table 1.

In another subset of the above embodiments, each linker is independently selected from Table 2.

In another subset of the above embodiments, the oligonucleotide or siRNA is double stranded; and the optional targeting ligands, solubilizing agents, pharmacokinetics enhancing agents, lipids, and/or masking agents are attached to the same or different strands of the oligonucleotide or siRNA.

In one embodiment, a modular composition comprises 1) a double stranded siRNA; 2) 1-8 tetraGalNAc ligands of Formula (IV), (V) or (VI), which may be the same or different:

(IV)

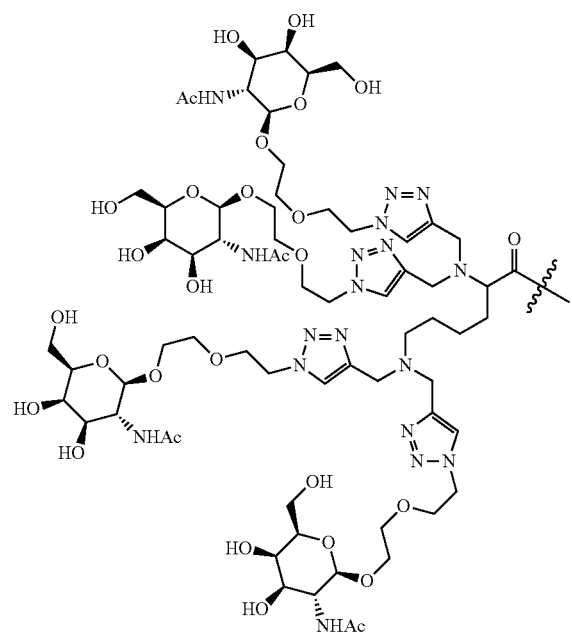

(V)

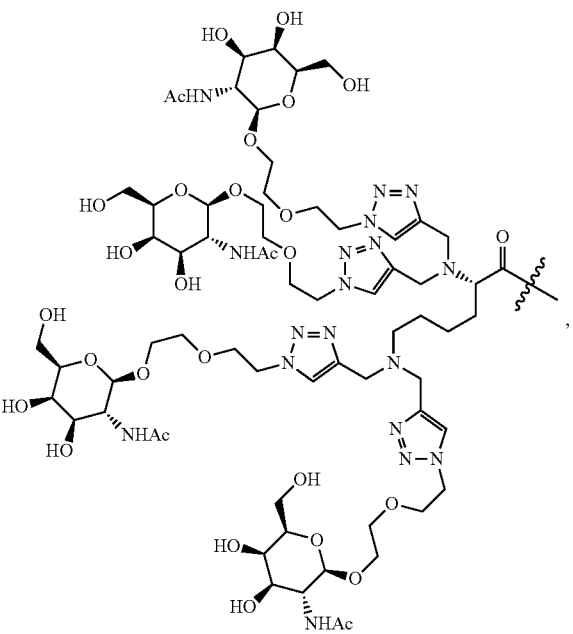

(VI)

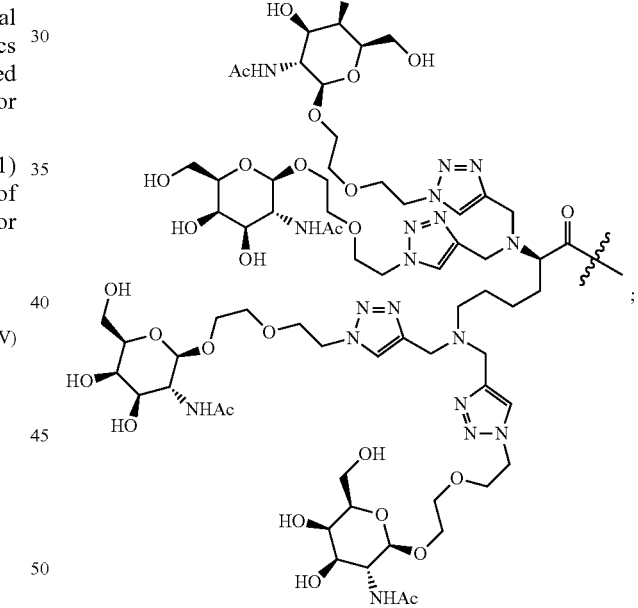

3) 1-24 linkers independently selected from Table 1, which may be the same or different; 4) 1-8 peptides independently selected from Table 3, which may be the same or different; and, optionally, 5) 1-8 targeting ligands, solubilizing agents, pharmacokinetics enhancing agents, lipids, and/or masking agents.

In another embodiment, a modular composition comprises 1) a double stranded siRNA; 2) 1-4 tetraGalNAc ligands of Formula (IV), (V) or (VI), which may be the same or different; 3) 1-12 linkers independently selected from Table 1, which may be the same or different; 4) 1-4 peptides independently selected from Table 3, which may be the same or different; and, optionally, 5) 1-4 targeting ligands, solubilizing agents, pharmacokinetics enhancing agents, lipids, and/or masking agents; wherein the tetraGalNAc ligands and/or the peptides are attached to the siRNA at different 2'-positions of the ribose rings and/or at different terminal 3' and/or 5'-positions of the siRNA; and wherein the tetraGalNAc ligands and/or the peptides are attached to the siRNA optionally via linkers.

In one subset of the above embodiments, the tetraGalNAc ligands and the peptides are attached to the same strand of the siRNA via linkers.

In another subset of the above embodiments, the tetraGalNAc ligands and the peptides are attached to different strands of the siRNA via linkers.

In one embodiment, a modular composition comprises 1) a double stranded siRNA; 2) 1-4 tetraGalNAc ligands of Formula (IV), (V) or (VI), which may be the same or different; 3) 1-12 linkers independently selected from Table 2, which may be the same or different; 4) 1-4 peptides independently selected from Table 4, which may be the same or different; and, optionally, 5) 1-4 targeting ligands, solubilizing agents, pharmacokinetics enhancing agents, lipids, and/or masking agents; wherein the tetraGalNAc ligands and/or the peptides are attached to the siRNA at different 2'-positions of the ribose rings and/or at different terminal 3' and/or 5'-positions of the siRNA; and wherein the tetraGalNAc ligands and/or the peptides are attached to the siRNA via linkers.

In one subset of the above embodiment, the tetraGalNAc ligands and the peptides are attached to the same strand of the siRNA via linkers.

In one subset of the above embodiment, the tetraGalNAc ligands and the peptides are attached to different strands of the siRNA via linkers.

Scheme 5 as shown in FIG. 7D-1 and FIG. 7D-2, FIG. 7E and FIG. 7F for preparing B-13 seq13-b compound. The figures disclose SEQ ID NO: 13.

Figure 1:
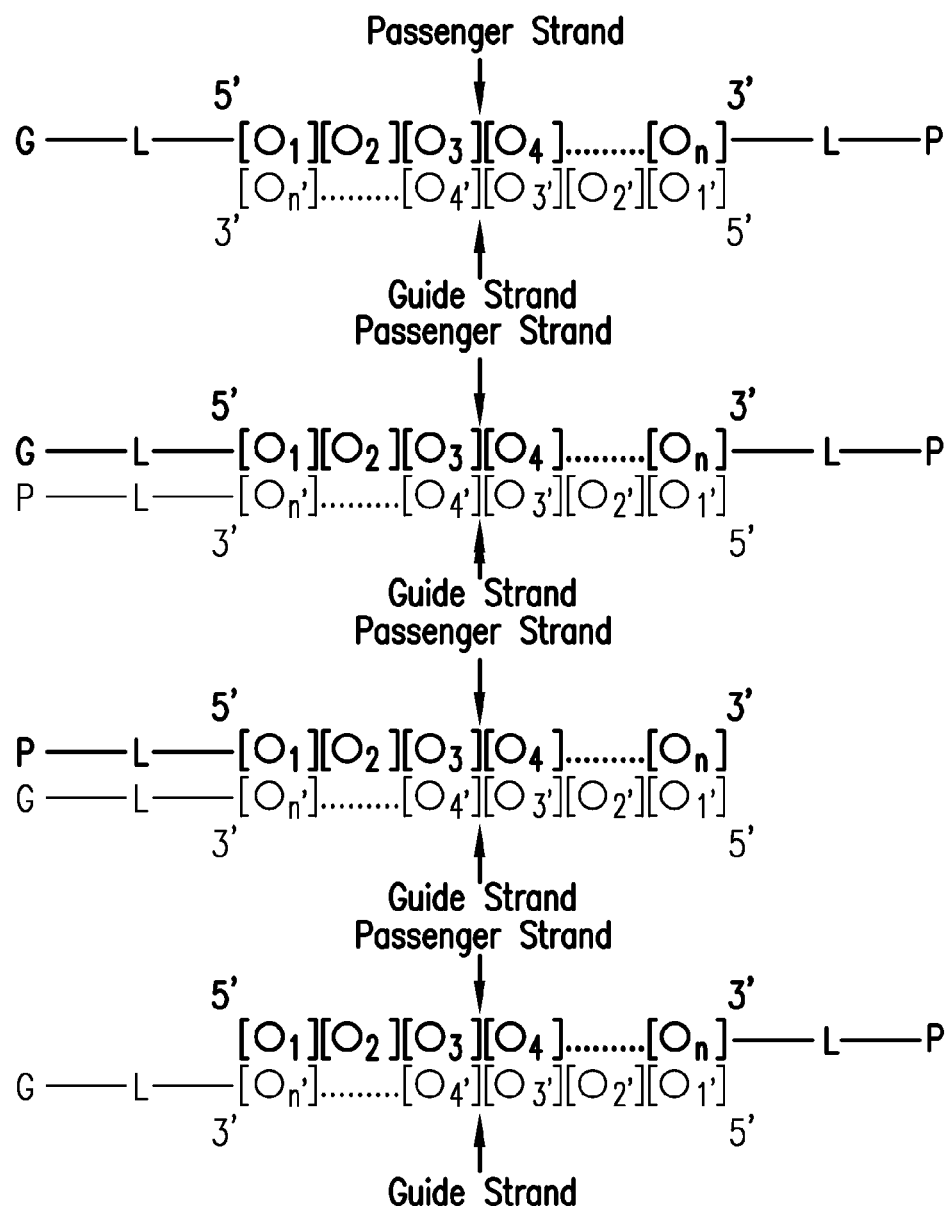
FIG. 1. Non-limiting examples of modular compositions comprising double stranded oligonucleotides with terminal conjugations.
Figure 2:
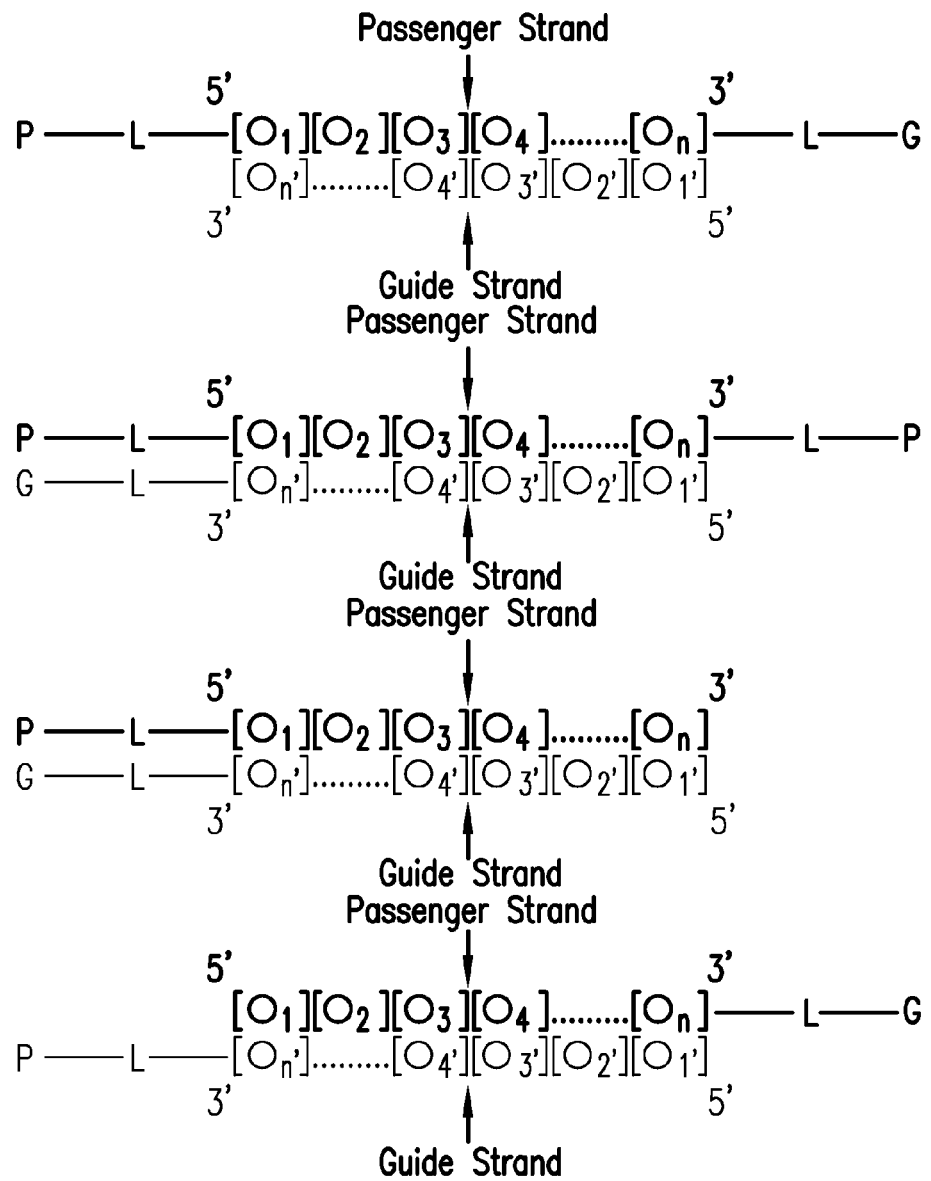
FIG. 2. Non-limiting examples of modular compositions comprising double stranded oligonucleotides with terminal conjugations.
Figure 7A:
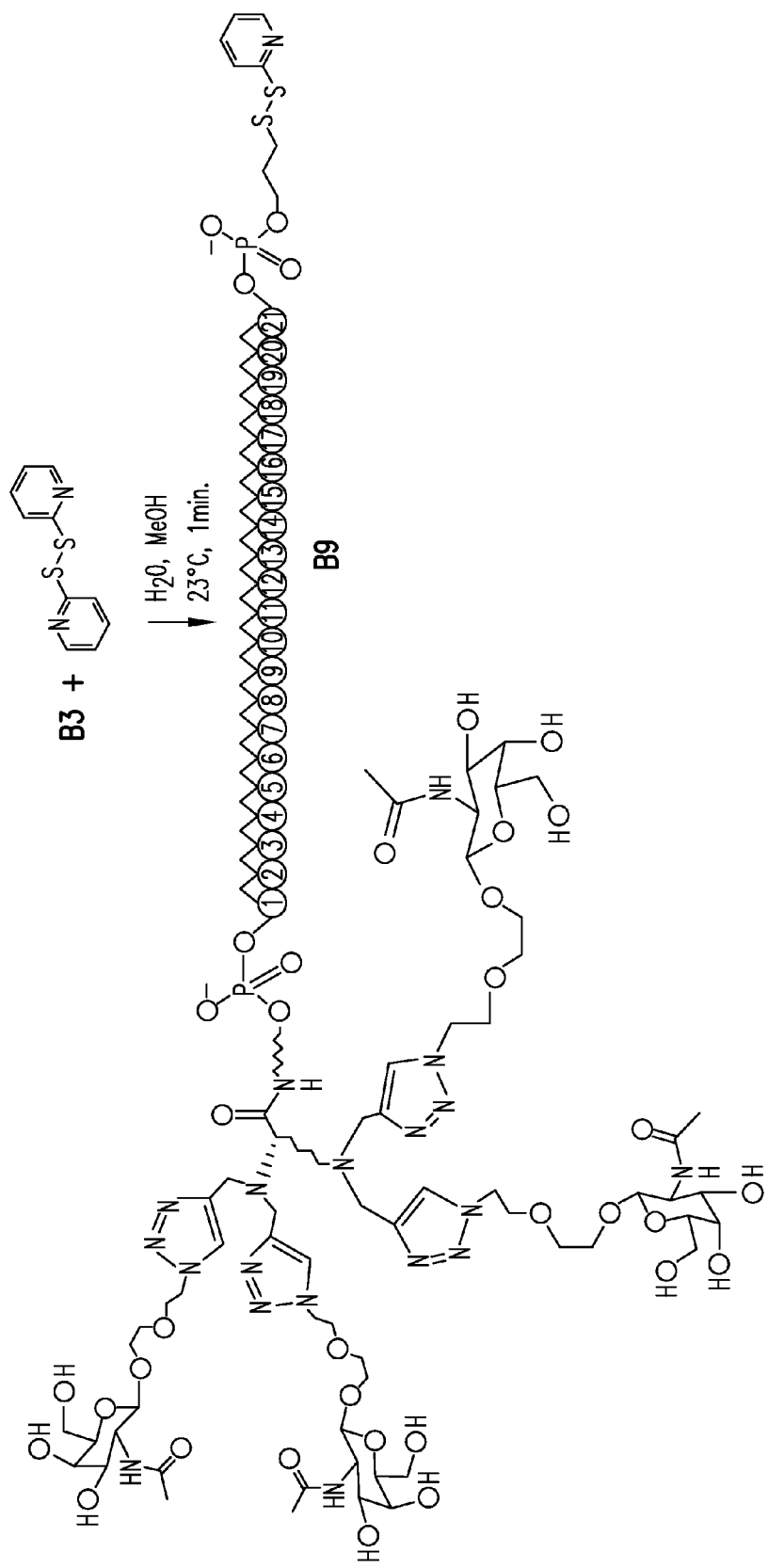
FIG. 7. Scheme 4 as shown in FIG. 7A, FIG. 7B and FIG. 7C for preparing B9, B10-seq32 and B11-seq32. The figures disclose SEQ ID NO: 32.
Figure 7B:
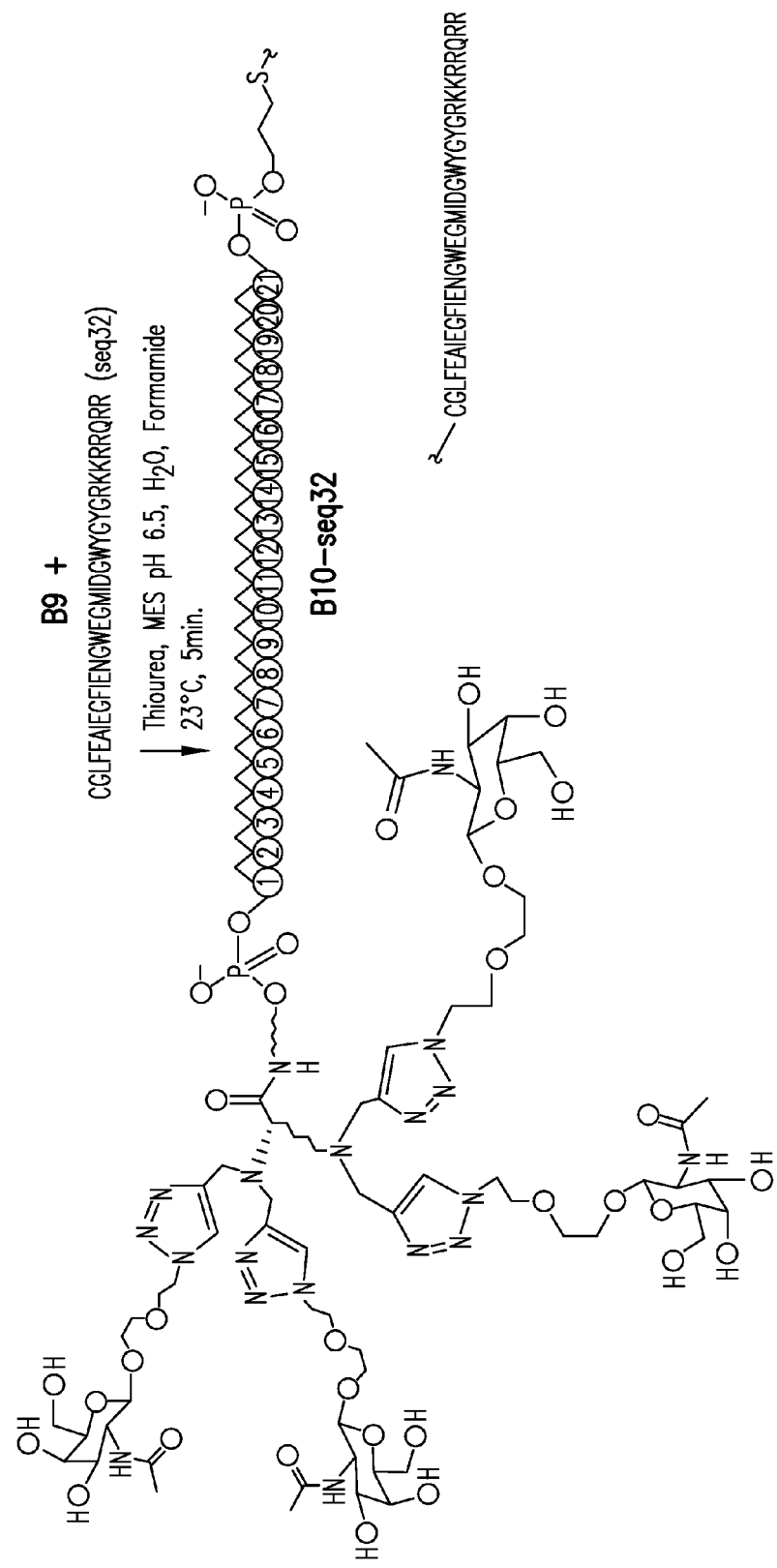
Figure 7C:
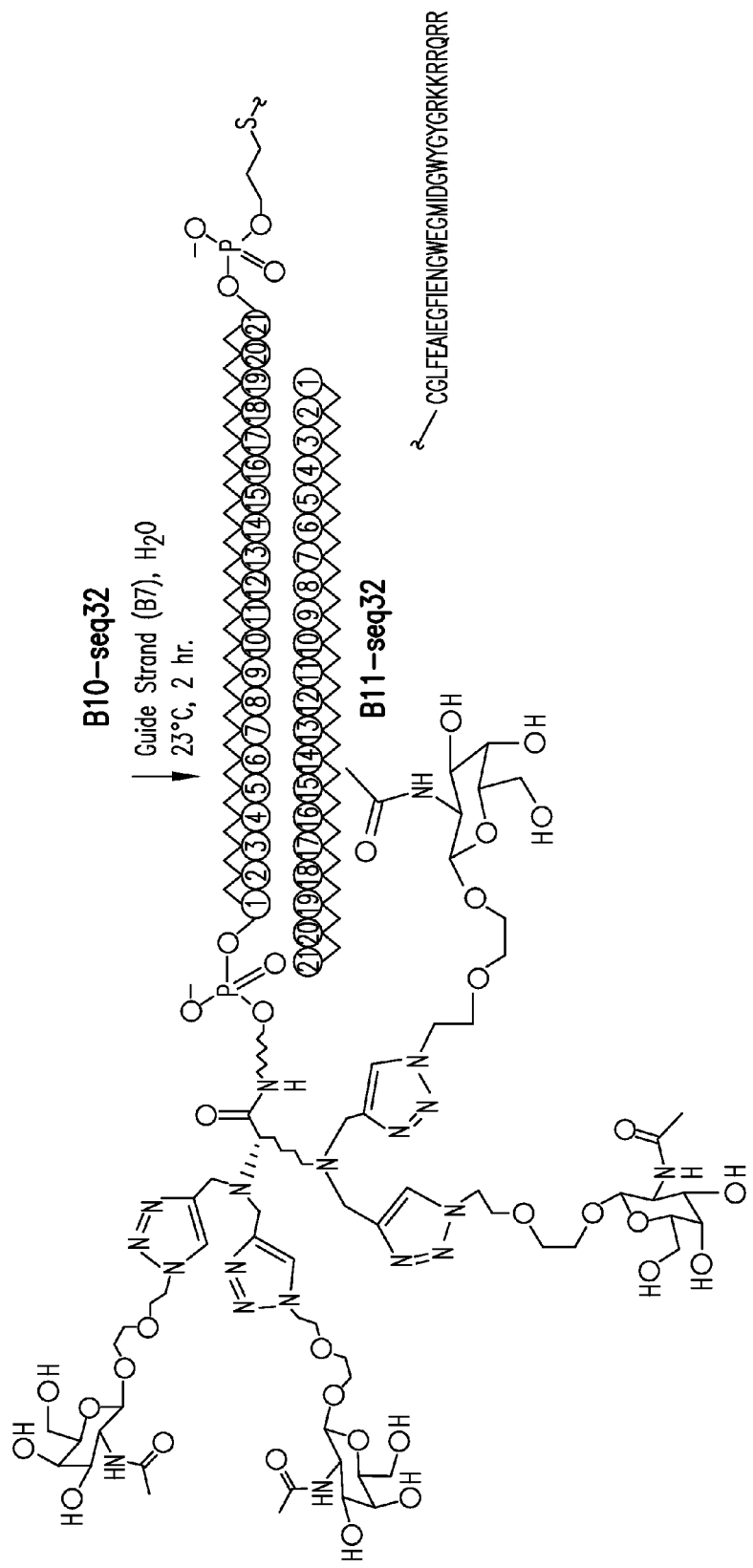
Figures 1, 7D:
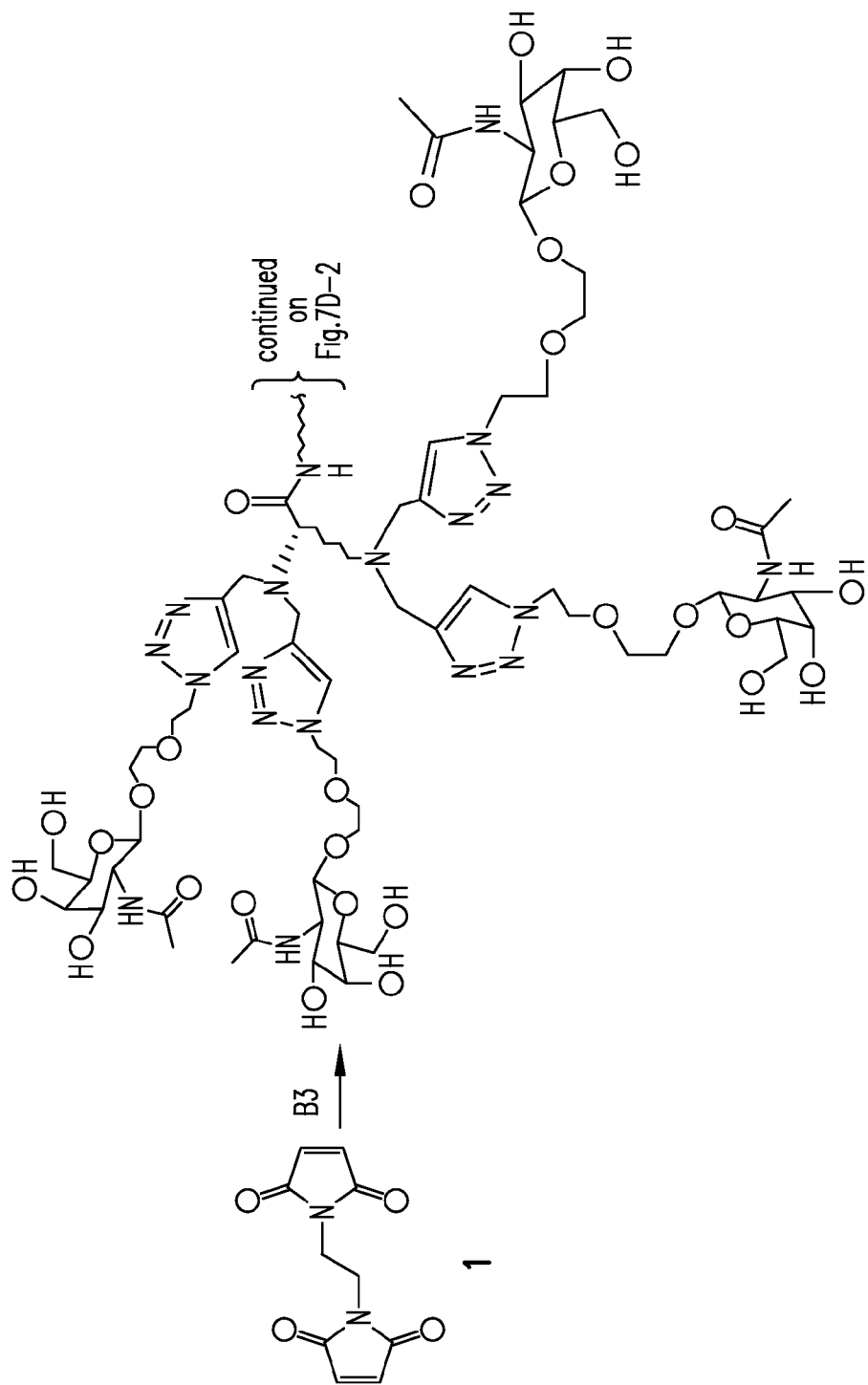
Figures 2, 7D:
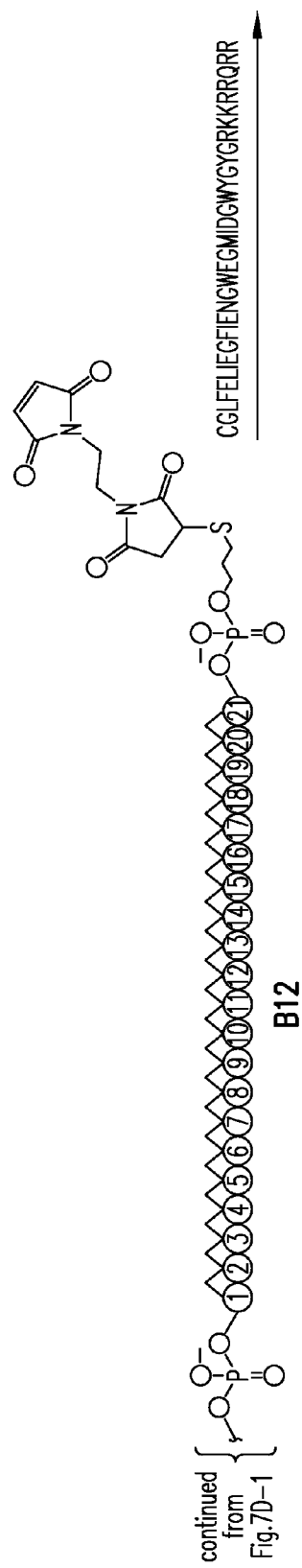
Figure 7E:
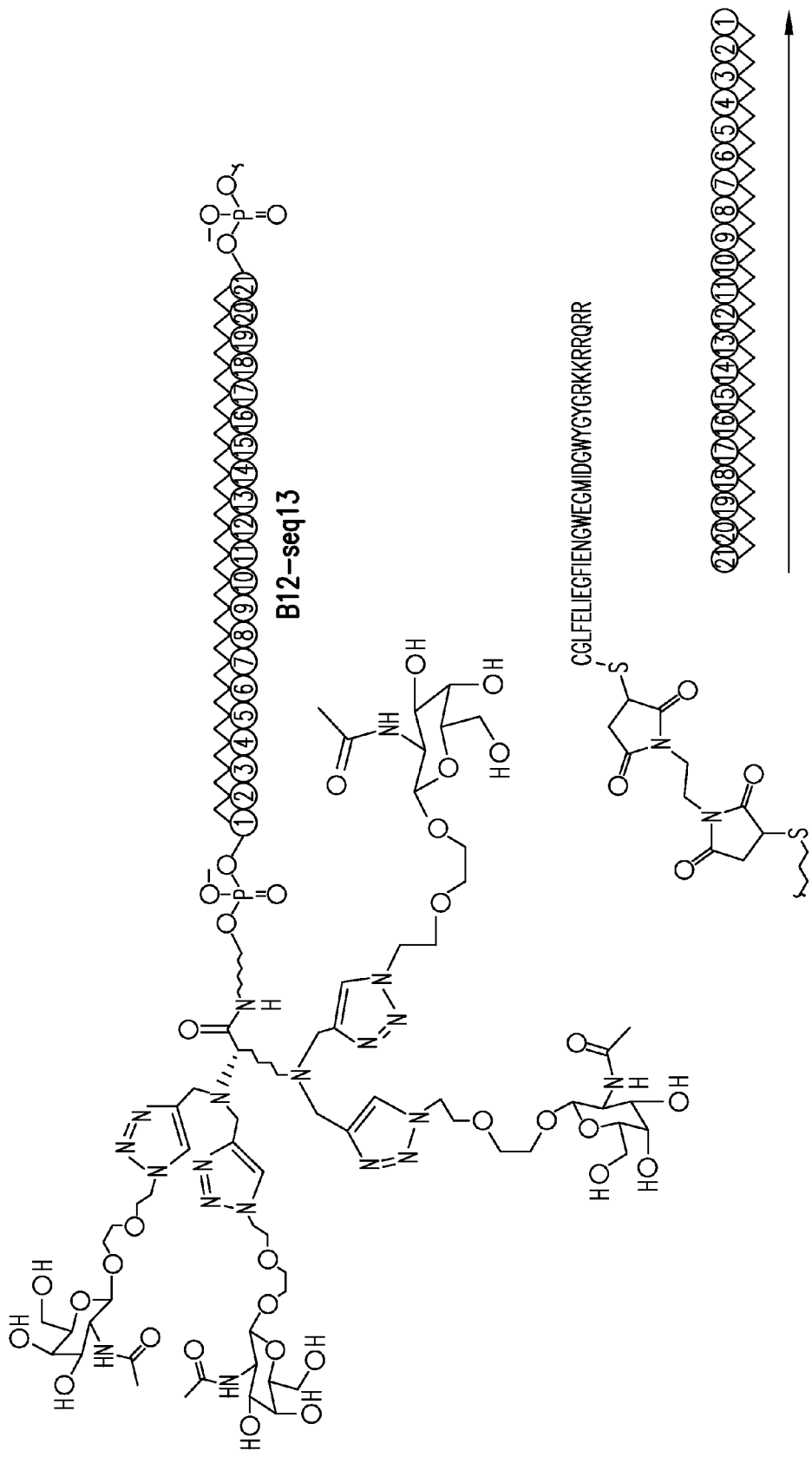
Figure 7F:
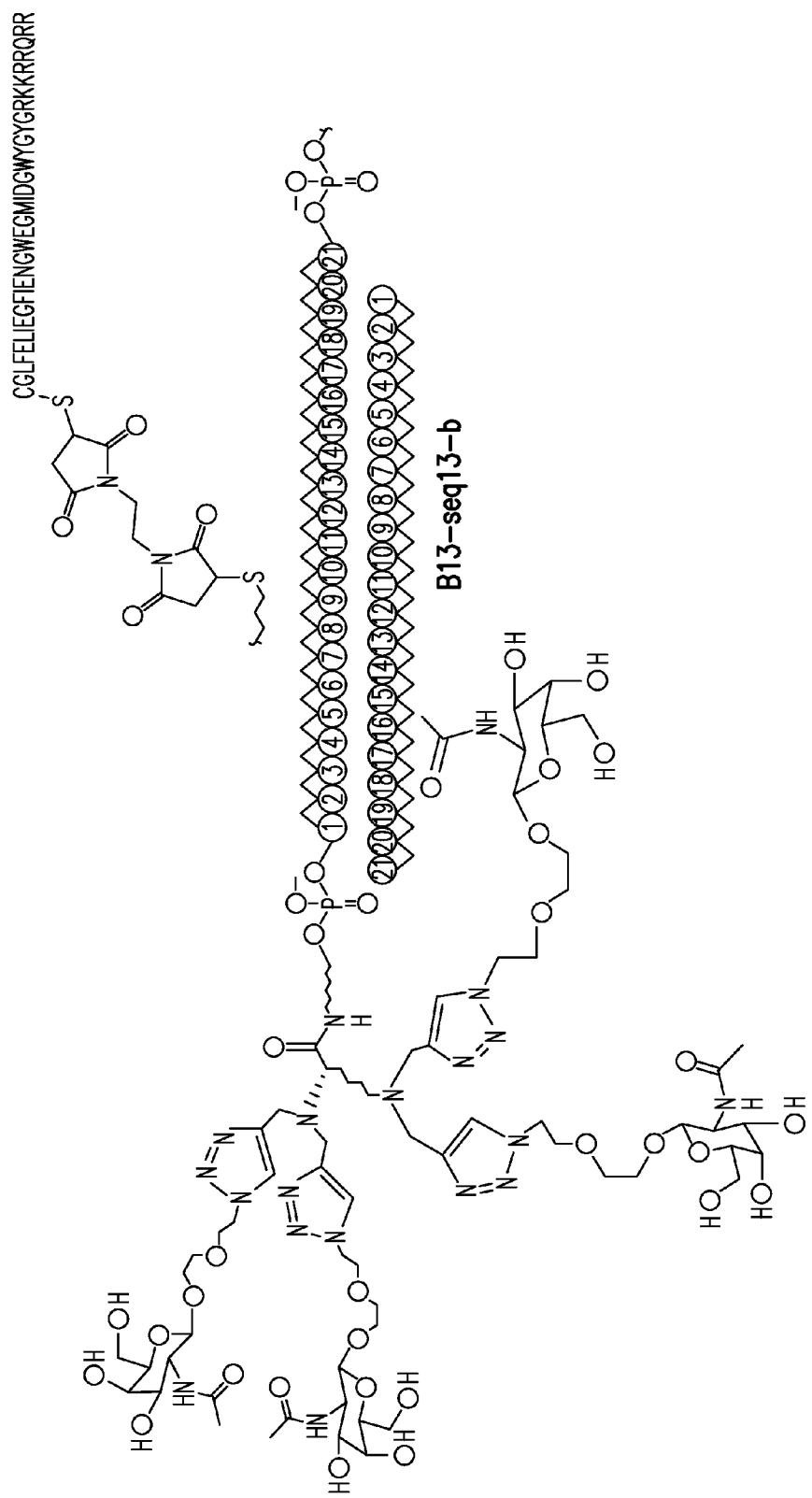
Figures 1, 7G:
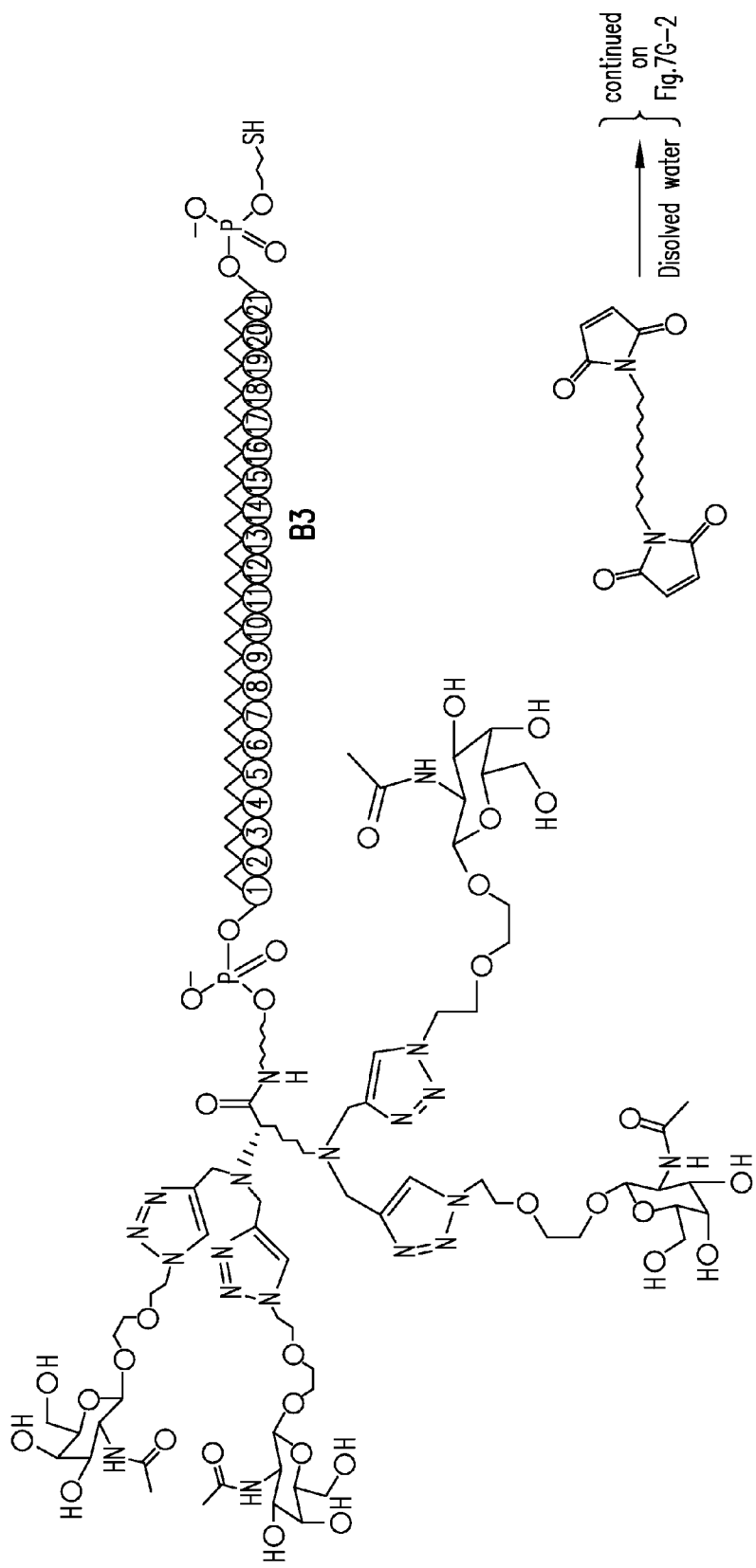
Figures 2, 7G:
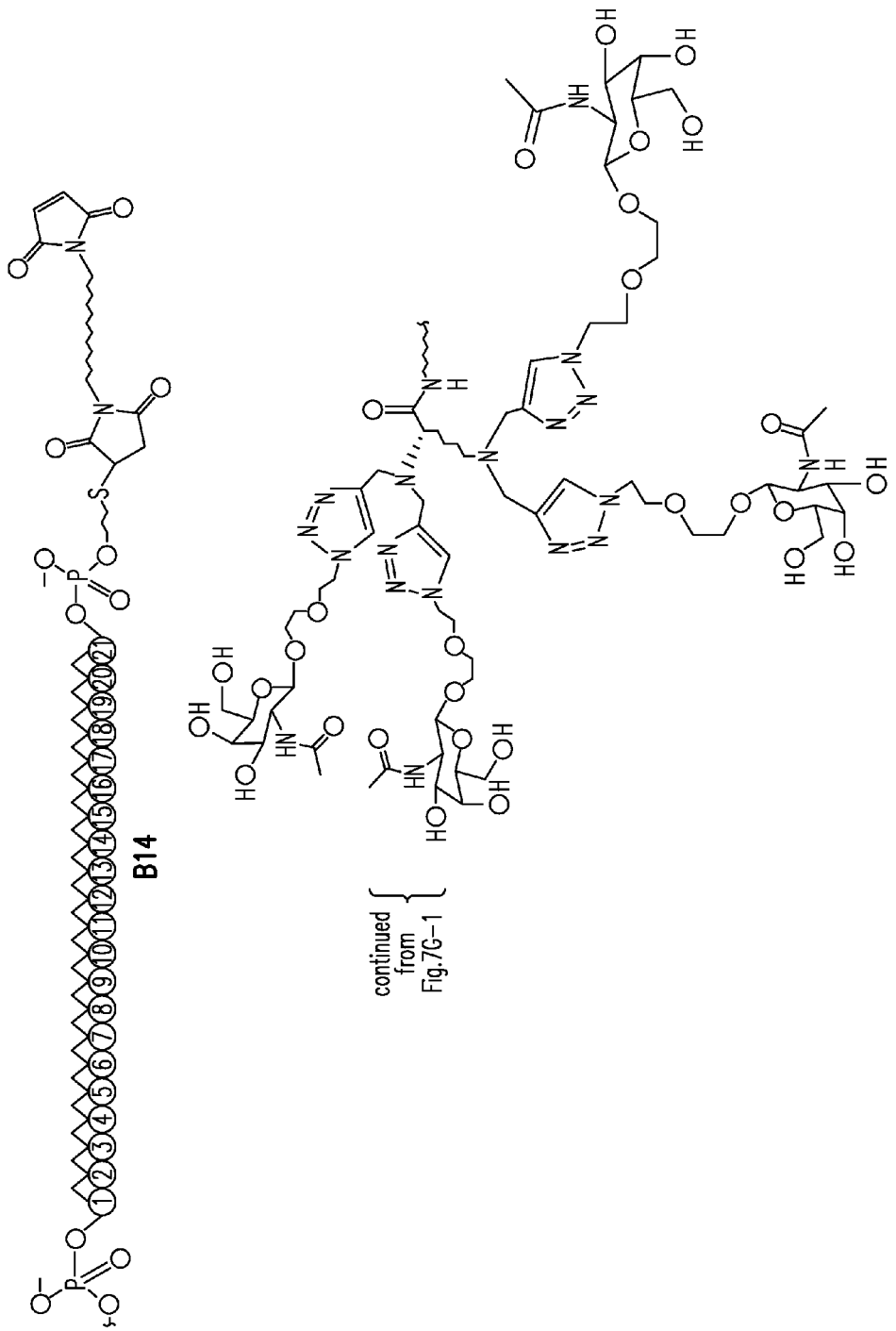

Scheme 6 as shown in FIG. 7G-1 to FIG. 7G-2 for preparing B16-seq32 and B17-seq32-b compound.

Figures 1, 7H:
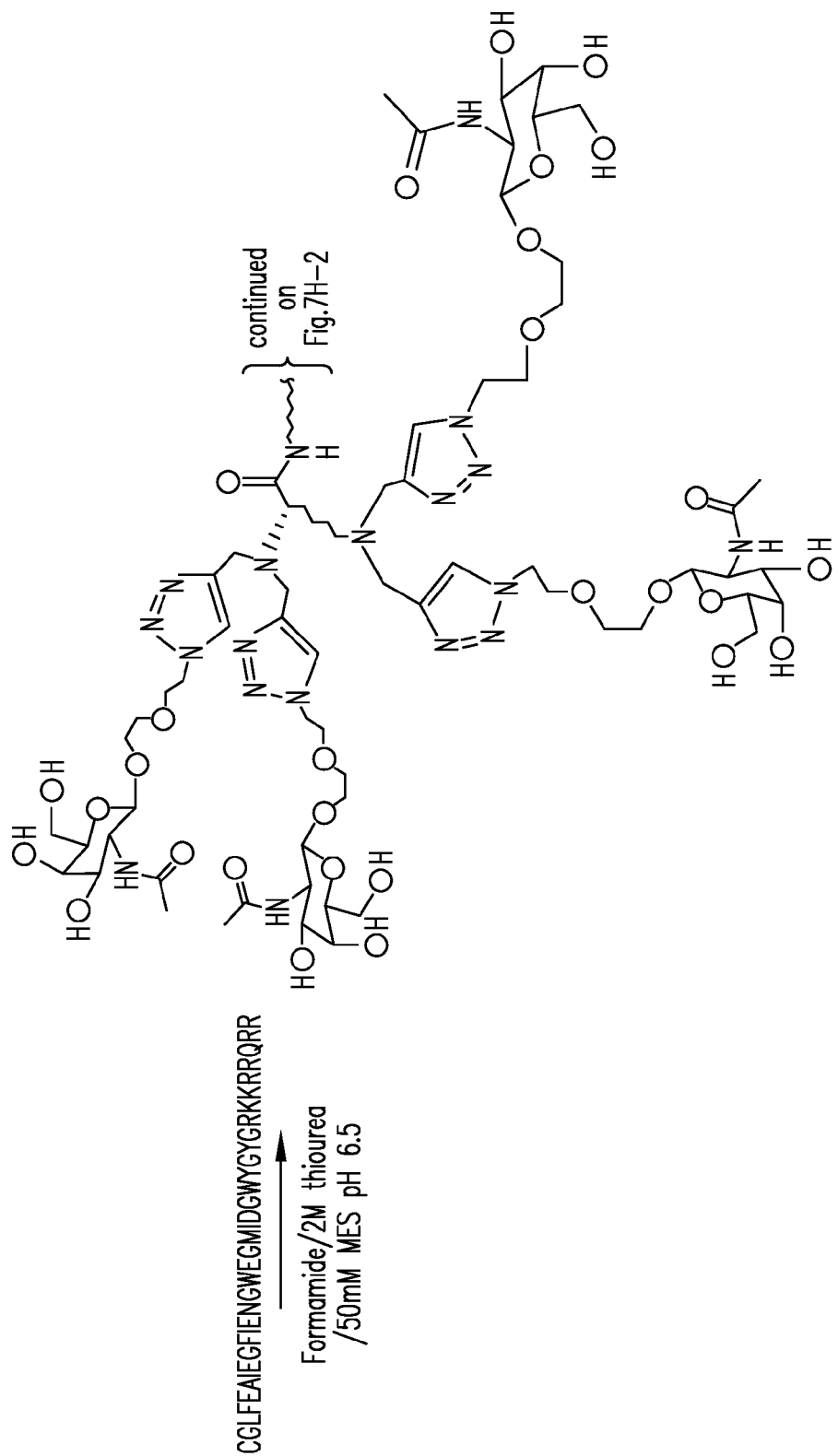
Figures 2, 7H:
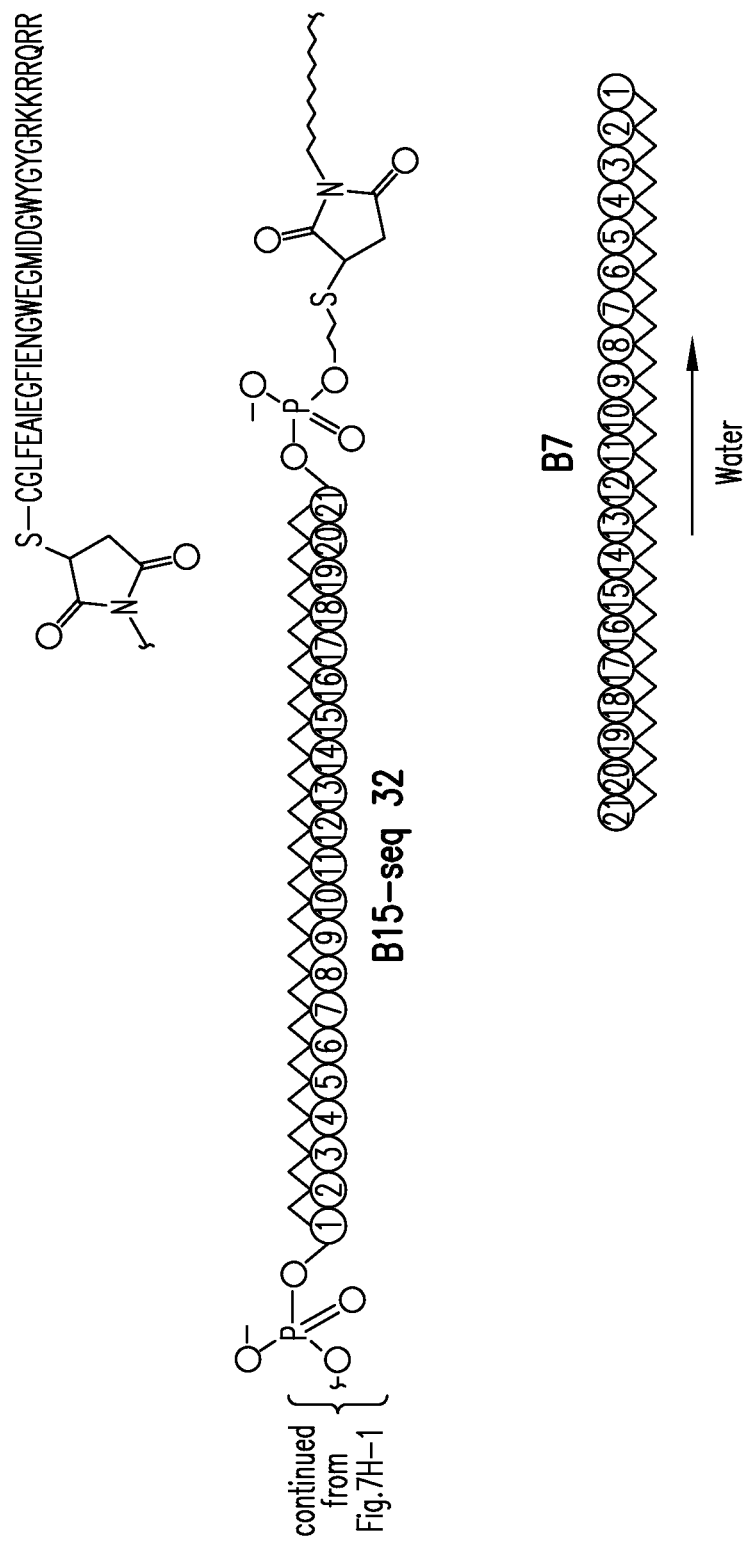
Figure 7I:
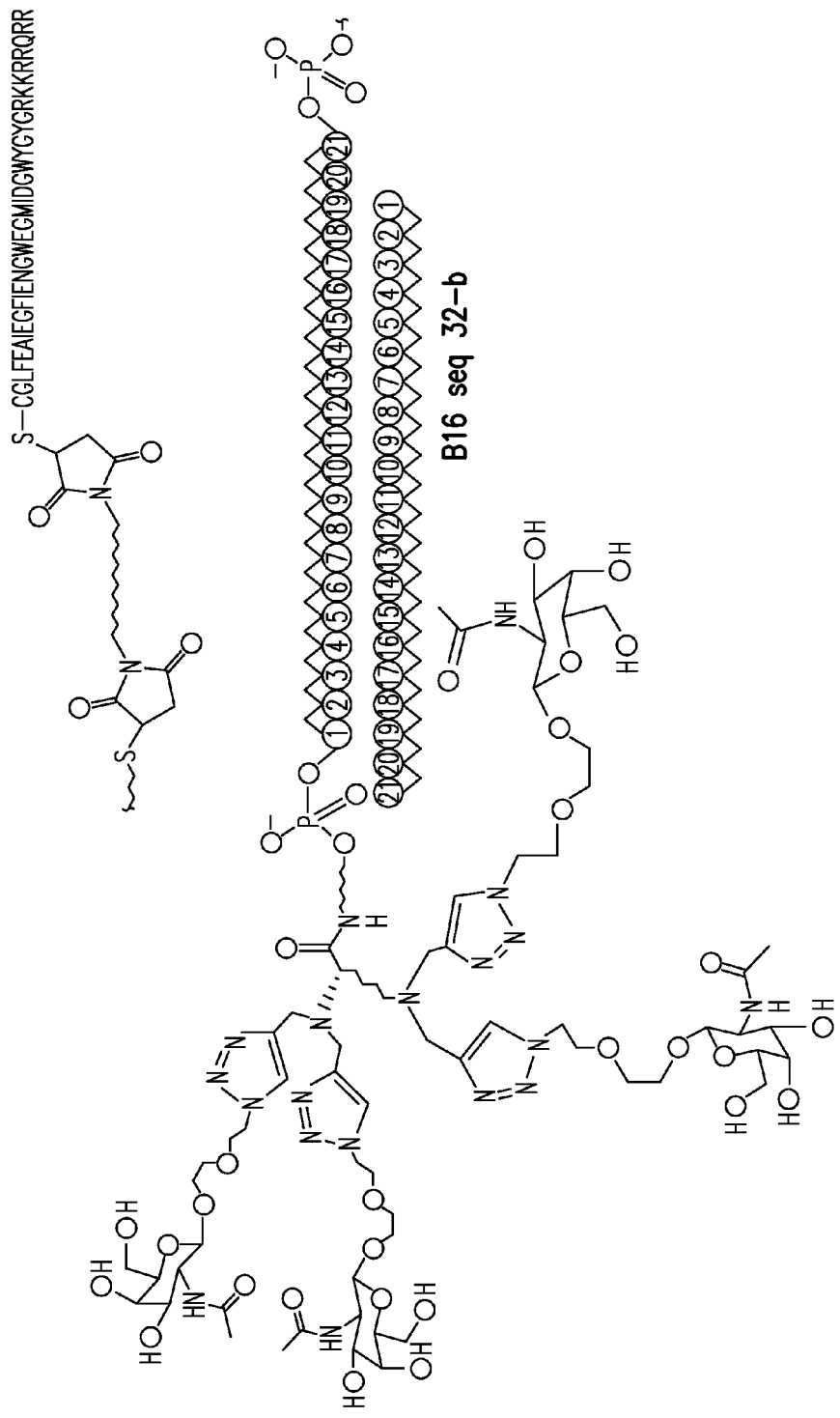
Figure 8A:
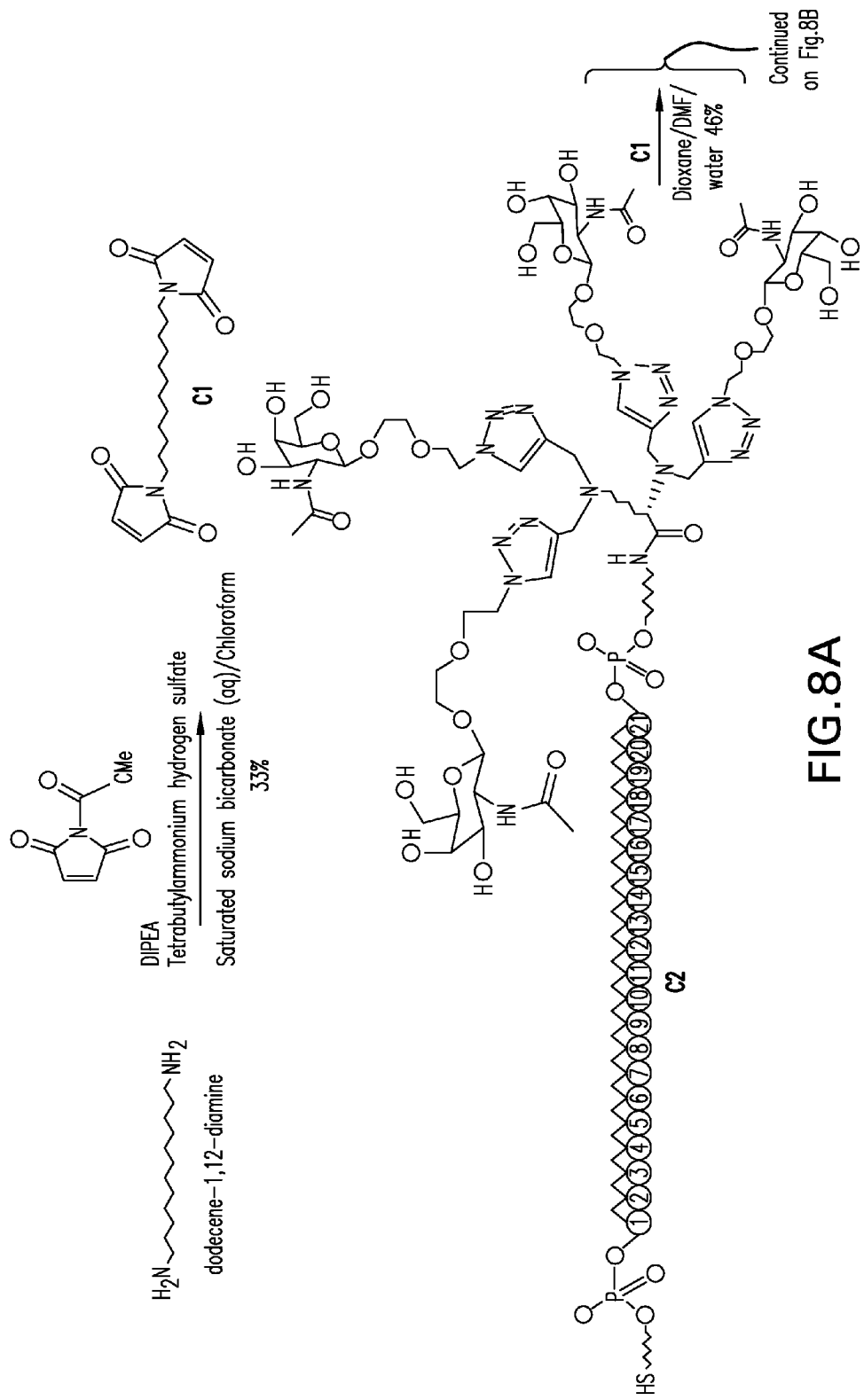
Figure 8B:
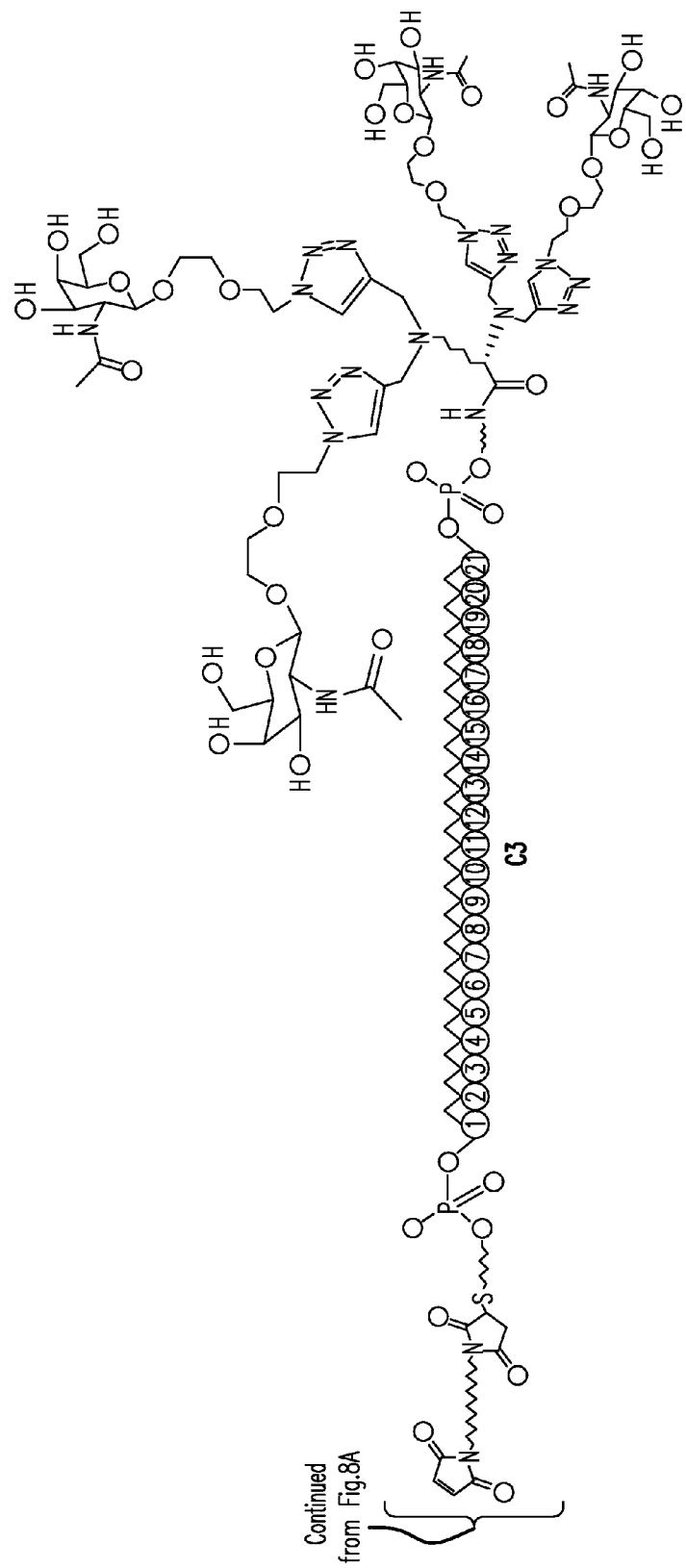
Figure 8C:
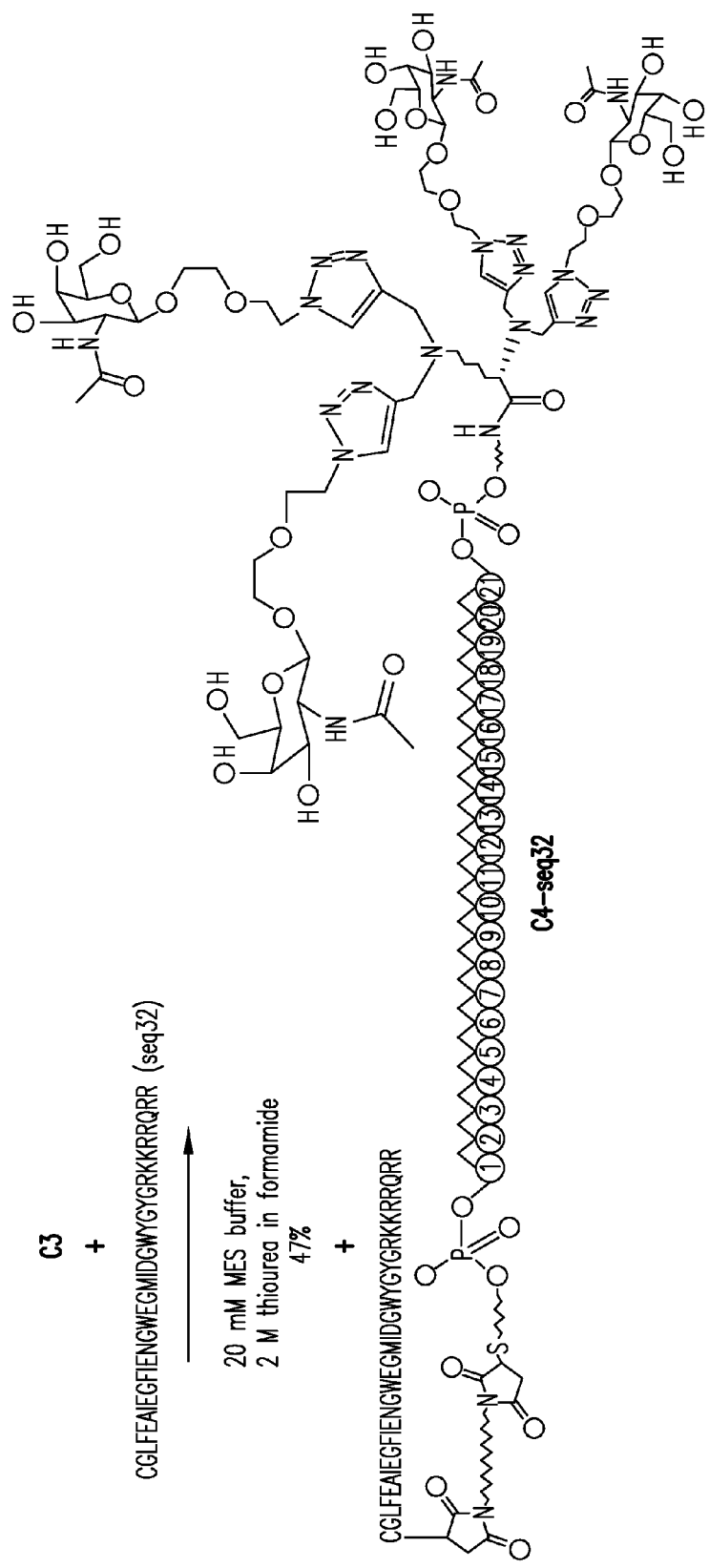
Figure 8D:
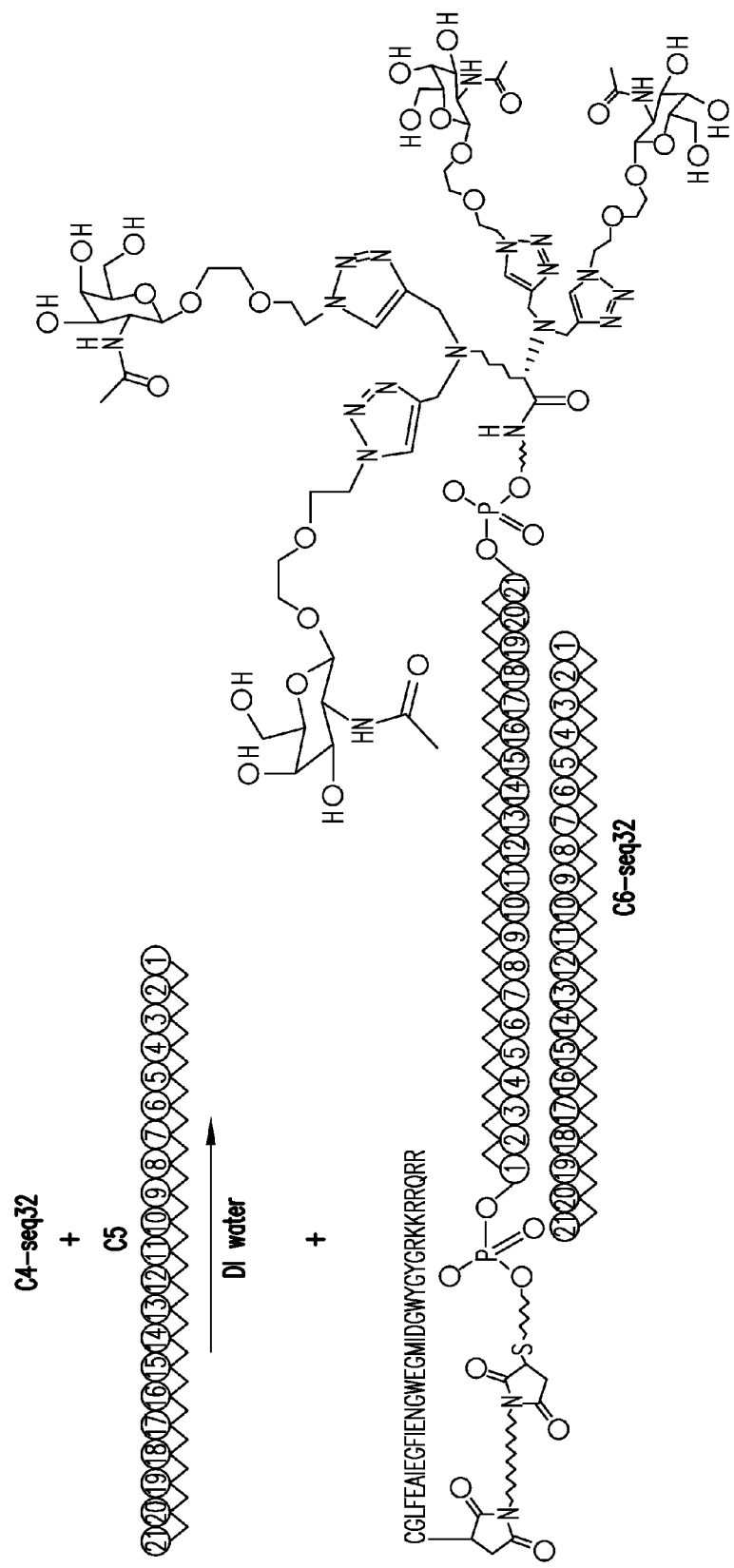
Figure 9A:
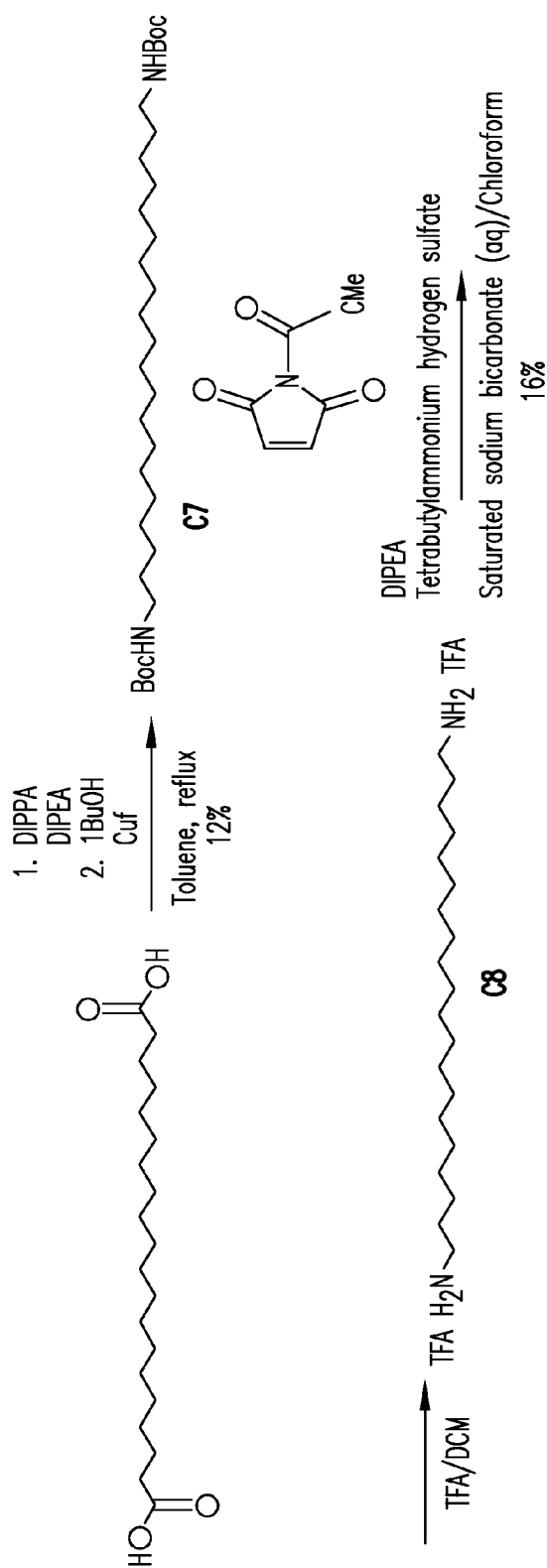
Figure 9B:
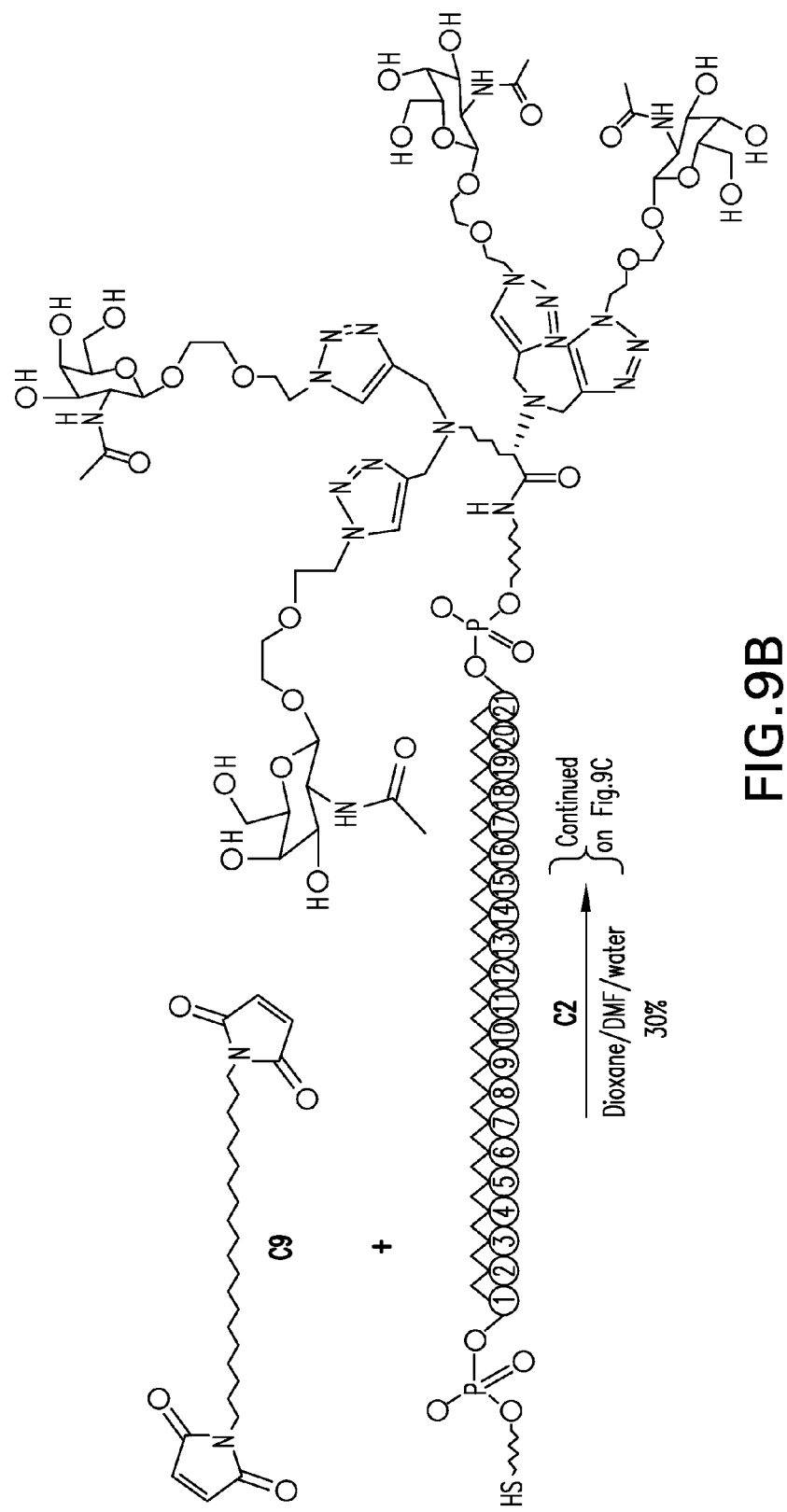
Figure 9C:
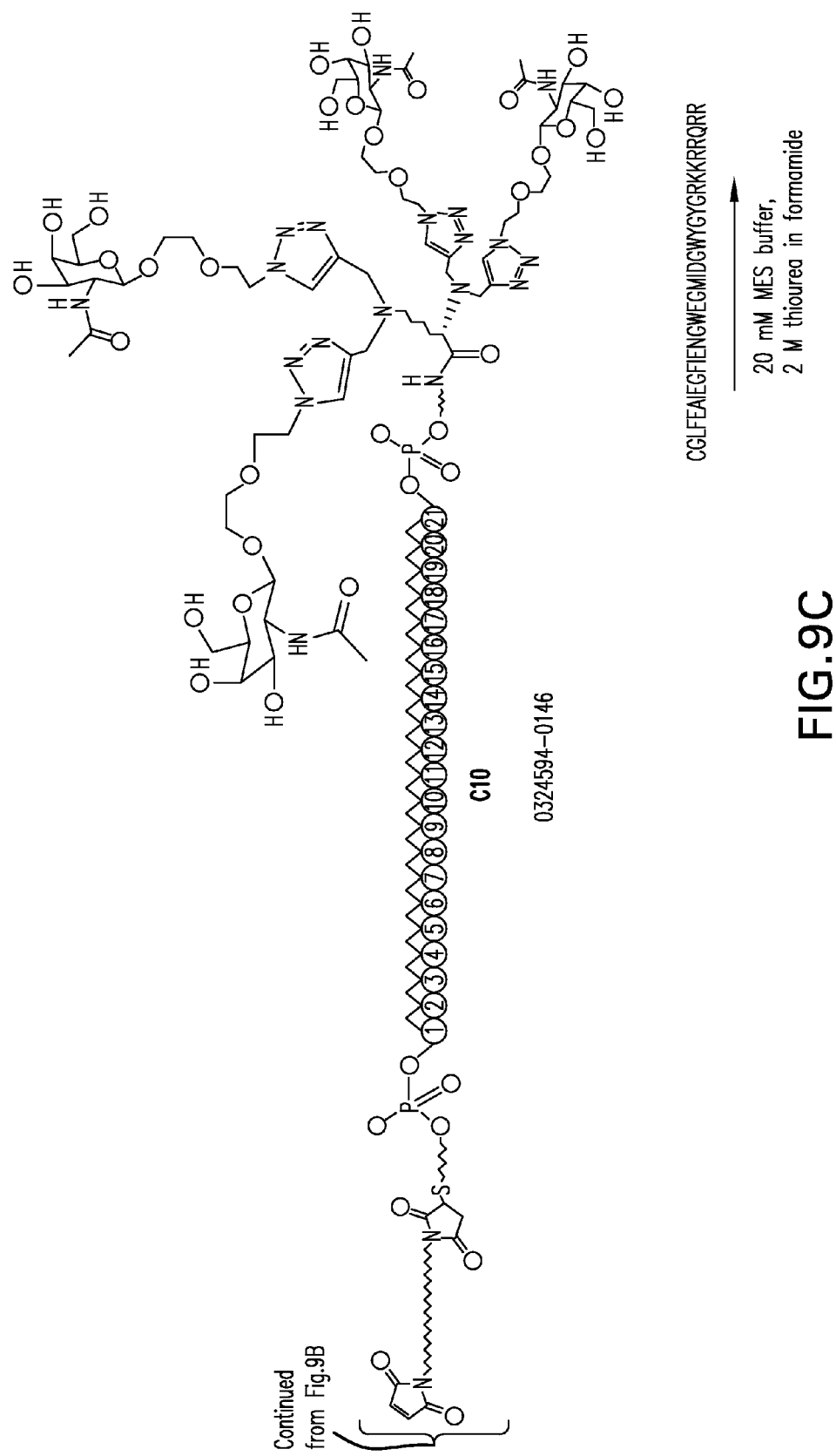
Figure 9D:
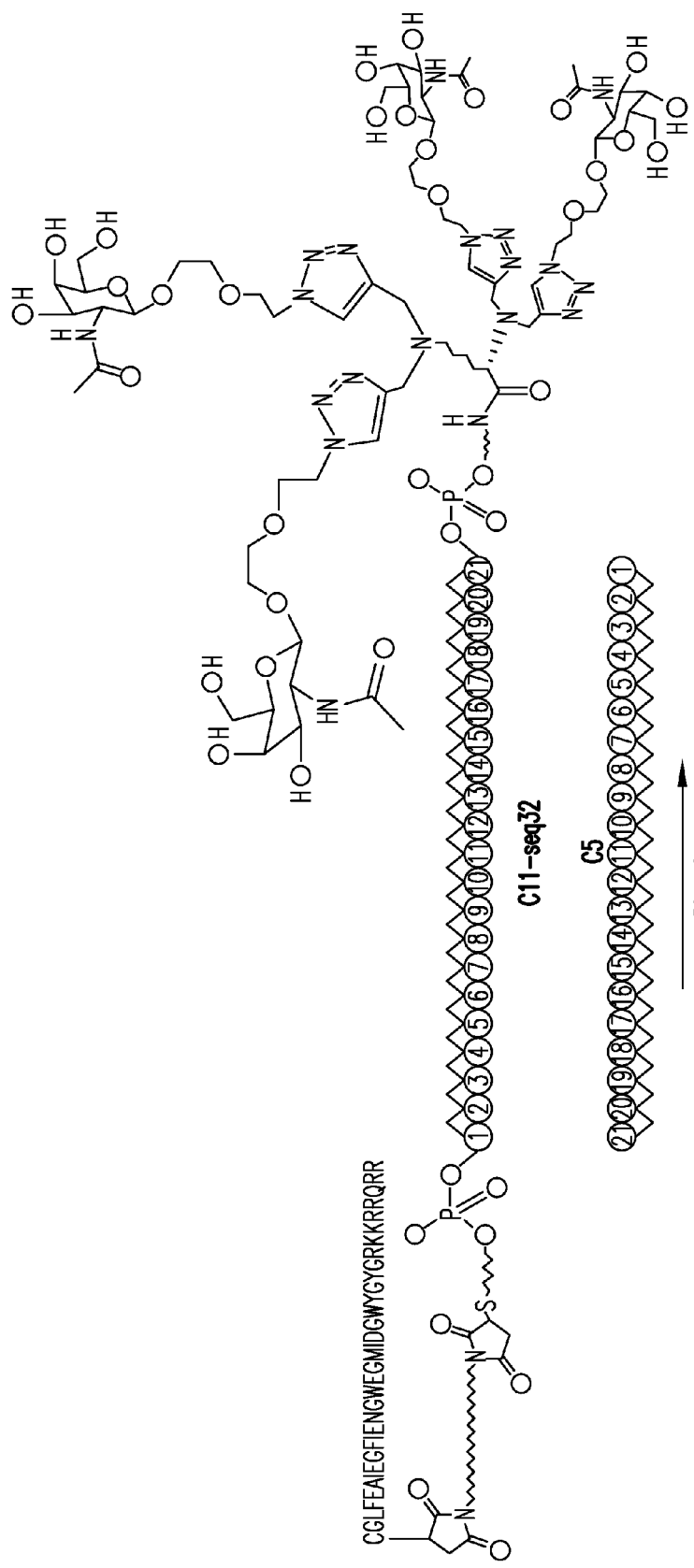
Figure 9E:
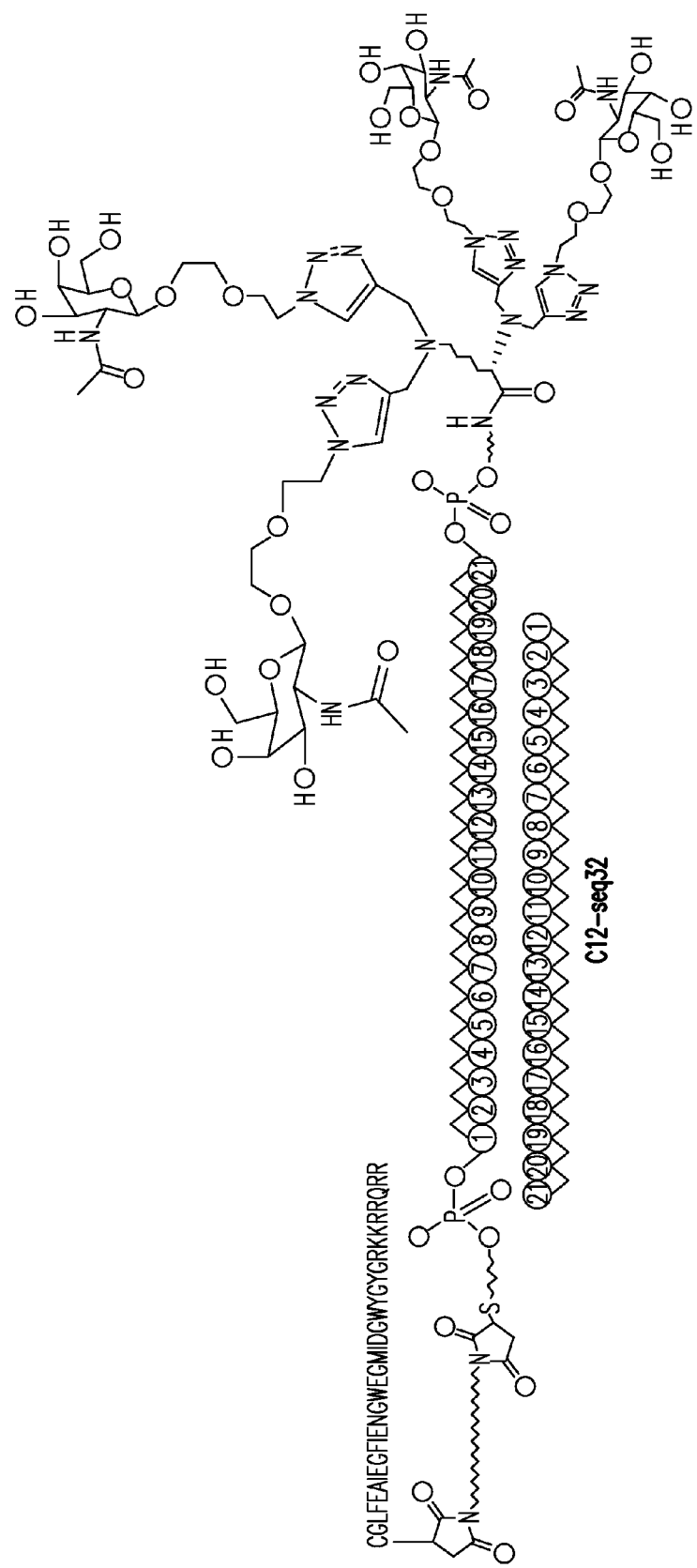

FIG. 7H-1, FIG. 7H-2, and FIG. 7I show the preparation of B15-seq32 and B16-seq32-b. FIGS. 7H-1 to 7I disclose SEQ ID NO: 32.

FIG. 8. Scheme 7 as shown in FIG. 8A to FIG. 8D for preparing C1 to C3, C4-seq32 and C6-seq32 compound. The figures disclose SEQ ID NO: 32.

FIG. 9. Scheme 8 as shown in FIG. 9A to FIG. 9E for preparing C7 to C10, C11-seq32 and C12-seq32 compound. The figures disclose SEQ ID NO: 32.

FIG. 10. Scheme 9 shown in FIG. 10 A to FIG. 10D for preparing C13, C14-seq32 and C15-seq32-a compound. The figures disclose SEQ ID NO: 32.

FIG. 11. Scheme 10 as shown in FIG. 11A to FIG. 11 D for preparing D1, D3 and D4.

FIG. 12. Scheme 11 as shown in FIG. 12A-1 to FIG. 12B-2 for preparing D5-seq32 and D7-seq32 compound. The figures disclose SEQ ID NO: 32.

FIG. 13. Scheme 12 as shown in FIG. 13A to FIG. 13H-2 for preparing E compounds.

FIG. 14. Scheme 13 as shown in FIG. 14A-1 to FIG. 14B-2 for preparing E8-seq 137 and E10-seq137e compounds. The figures disclose SEQ ID NO: 137.

FIG. 15. Scheme 14 as shown in FIG. 15A to FIG. 15E-2 for preparing F compounds. The figures disclose SEQ ID NO: 463.

FIG. 16. Scheme 15 as shown in FIG. 16A-1 to FIG. 16B-2 for preparing F6seq 463-f compound. The figures disclose SEQ ID NO: 463.

FIG. 17. Scheme 16 as shown in FIG. 17A-1 to FIG. 17D-2 for preparing G compounds. The figures disclose SEQ ID NO: 489.

FIG. 18. Scheme 17 as shown in FIG. 18A-1 to FIG. 18B-2 for preparing G compounds. The figures disclose SEQ ID NO: 489.

FIG. 19. Scheme 19 as shown in FIG. 19A to FIG. 19I-2 for preparing H10-seq32-h compound. The figures disclose SEQ ID NO: 32.

FIG. 20. Scheme 20 as shown in FIG. 20A-1 to FIG. 20E-2 for preparing I10-seq1681-f compound. The figures disclose SEQ ID NOS 1737, 1737-1739, 1737, 1737, and 1737, respectively, in order of appearance.

FIG. 21. Scheme 21 as shown in FIG. 21A to FIG. 21H-2 for preparing J9-seq26-i compound. The figures disclose SEQ ID NO: 26.

FIG. 22. Scheme 22 as shown in FIG. 22A-1 to FIG. 22D-2 for preparing K6 seq 74-b compound. The figures disclose SEQ ID NO: 74.

FIG. 23. Scheme 23 as shown in FIG. 23A to FIG. 23C-2 for preparing L11 seq 463-j compound. The figures disclose SEQ ID NO: 463.

FIG. 24. Scheme 24 as shown in FIG. 24A-1 to FIG. 24B-2 for preparing M4-seq-j compound. The figures disclose SEQ ID NO: 463.

Figure 25A:
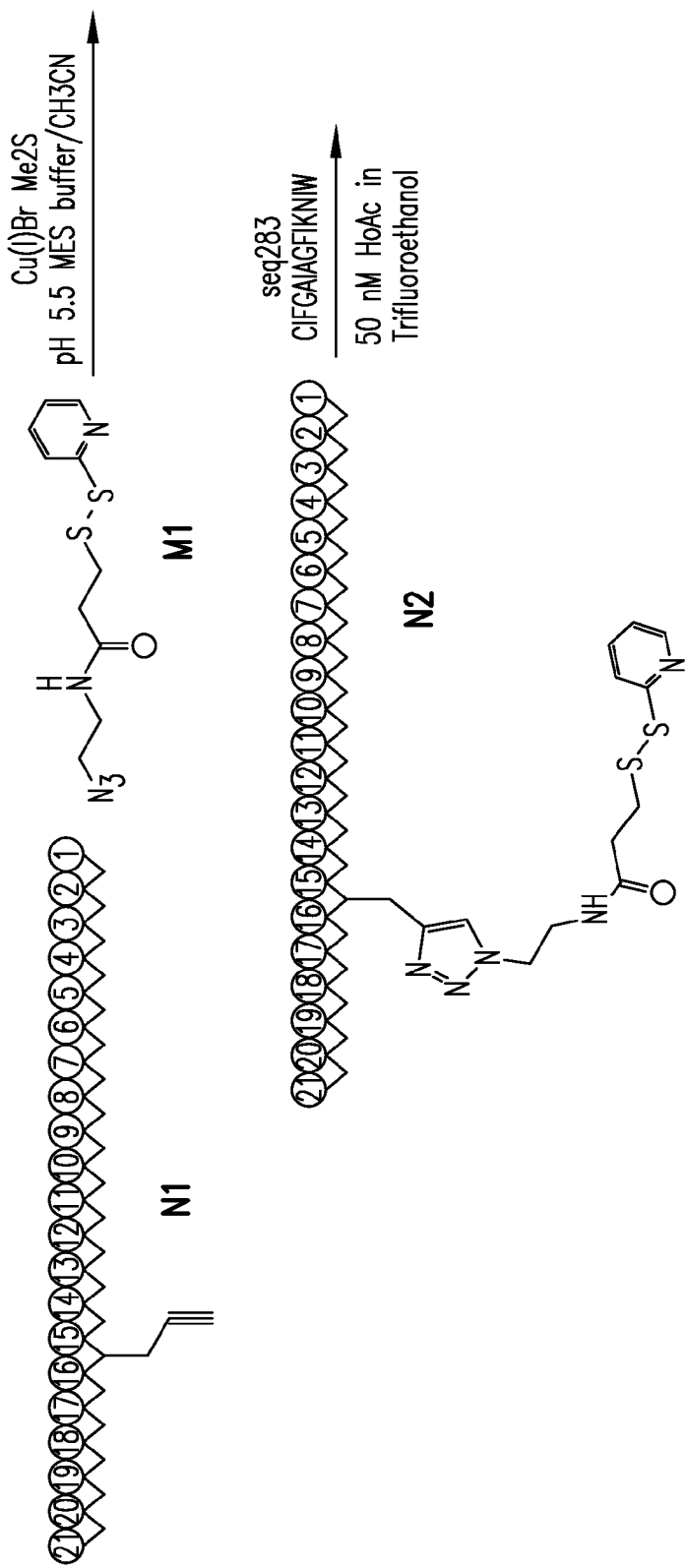
Figures 1, 25B:
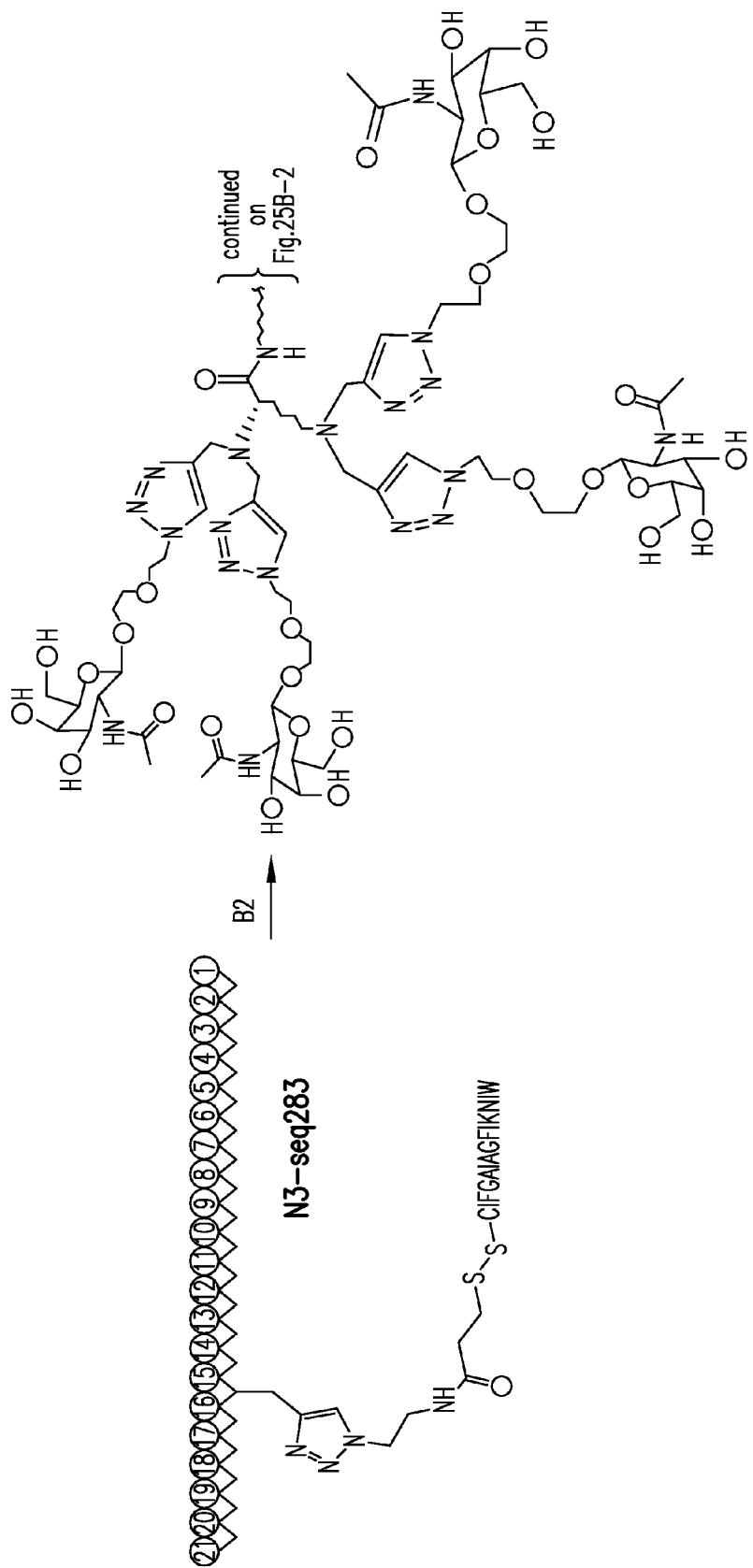
Figures 2, 25B:
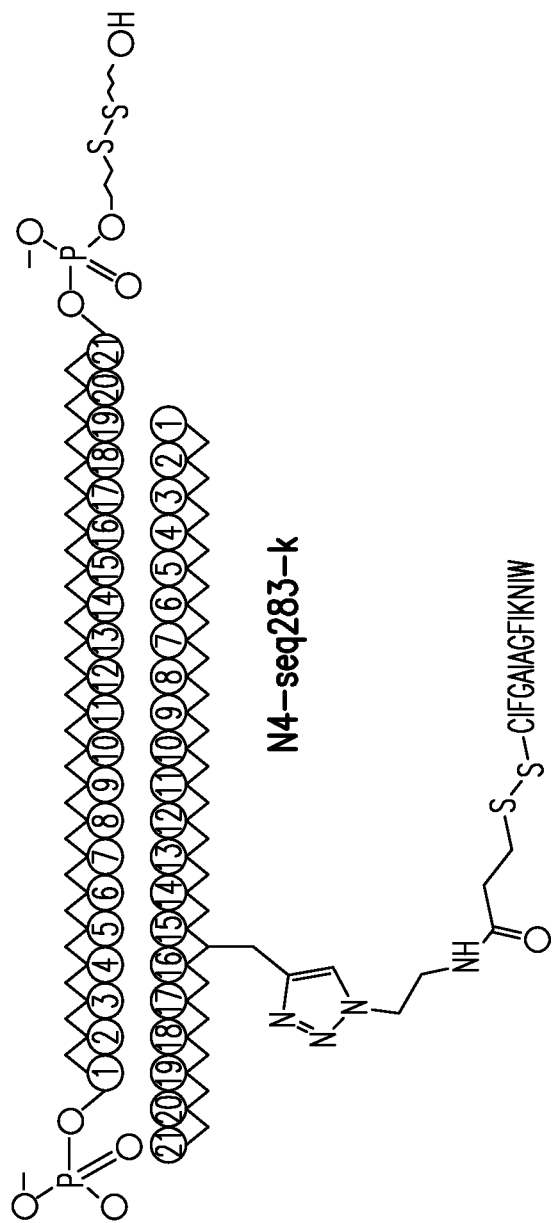
Figures 1, 26A:
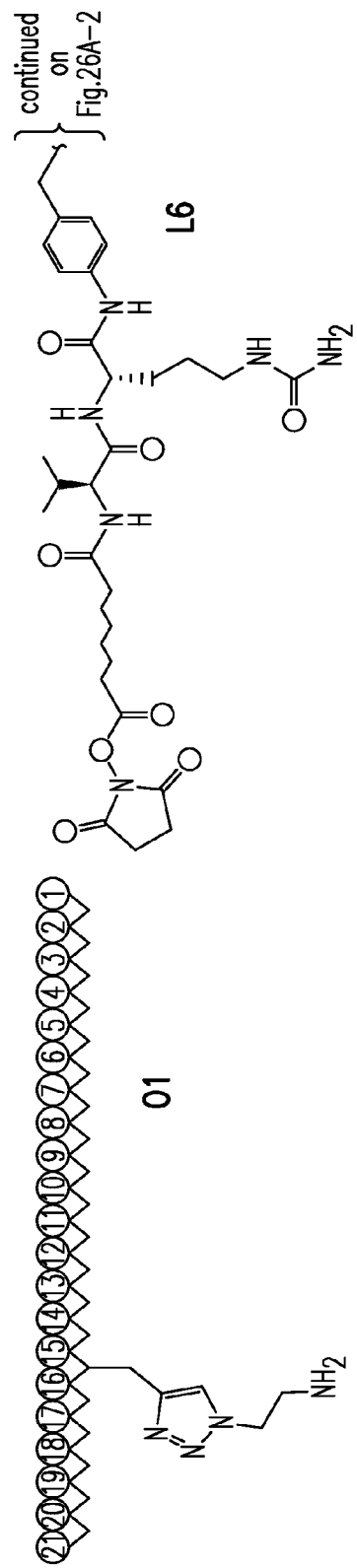
Figures 2, 26A:
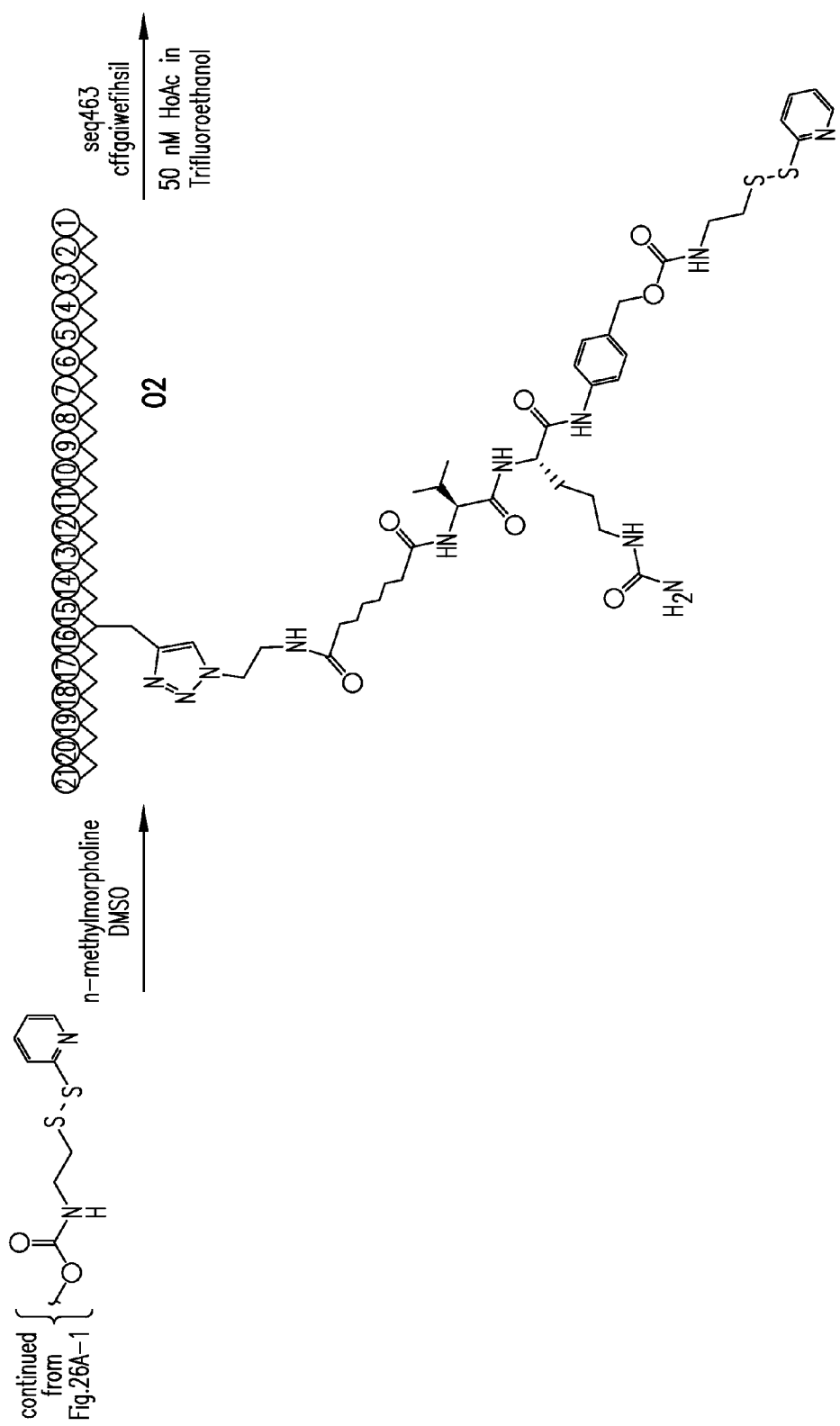
Figures 1, 26B:
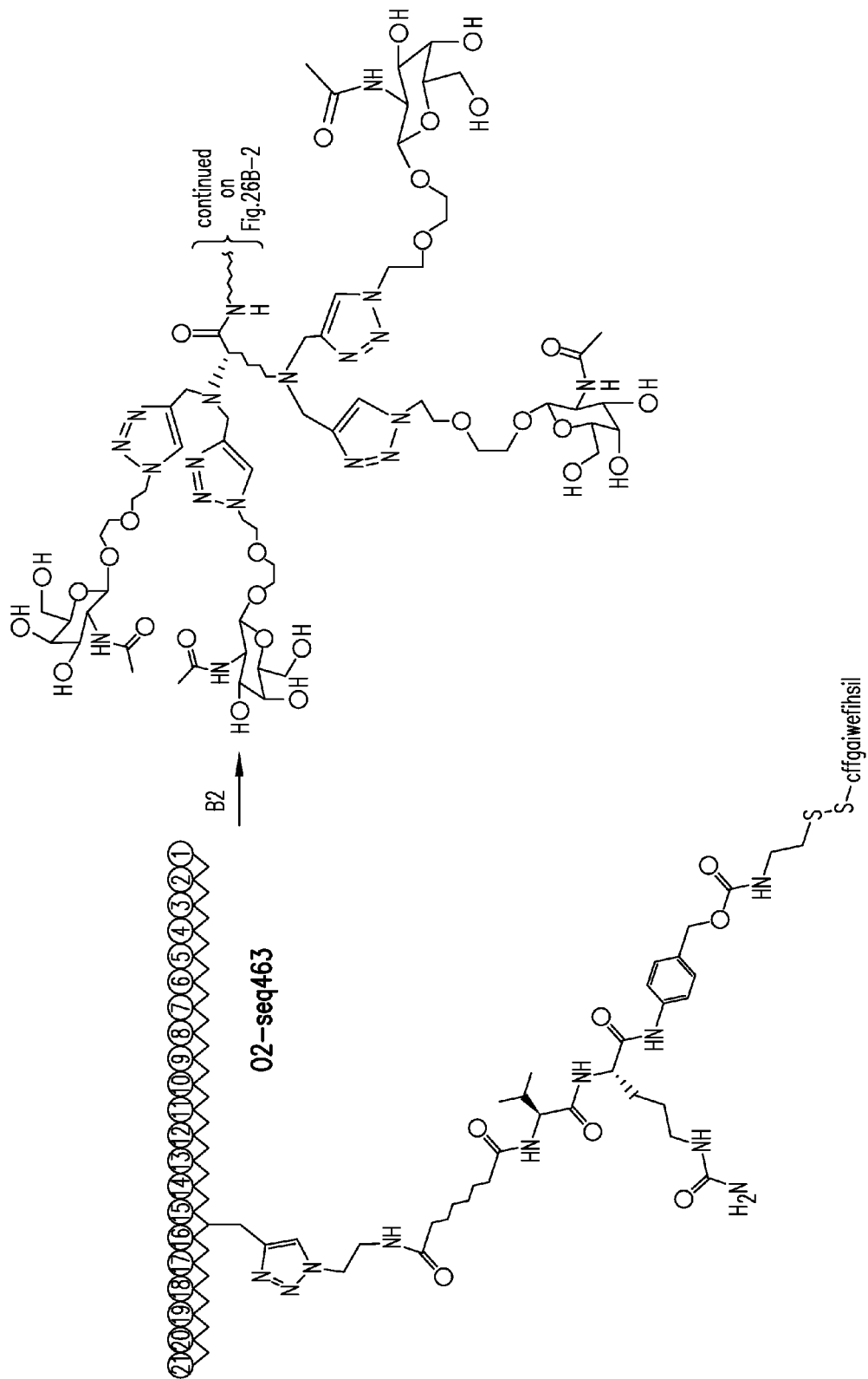
Figures 2, 26B:
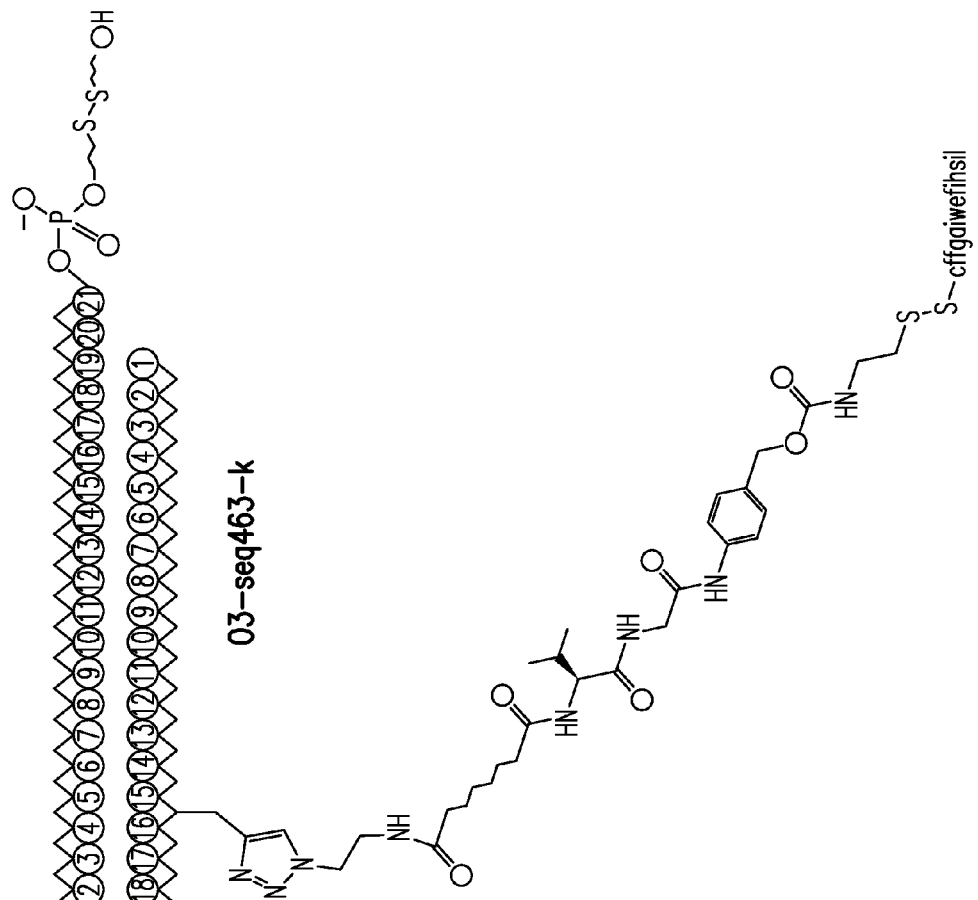
Figures 1, 27A:
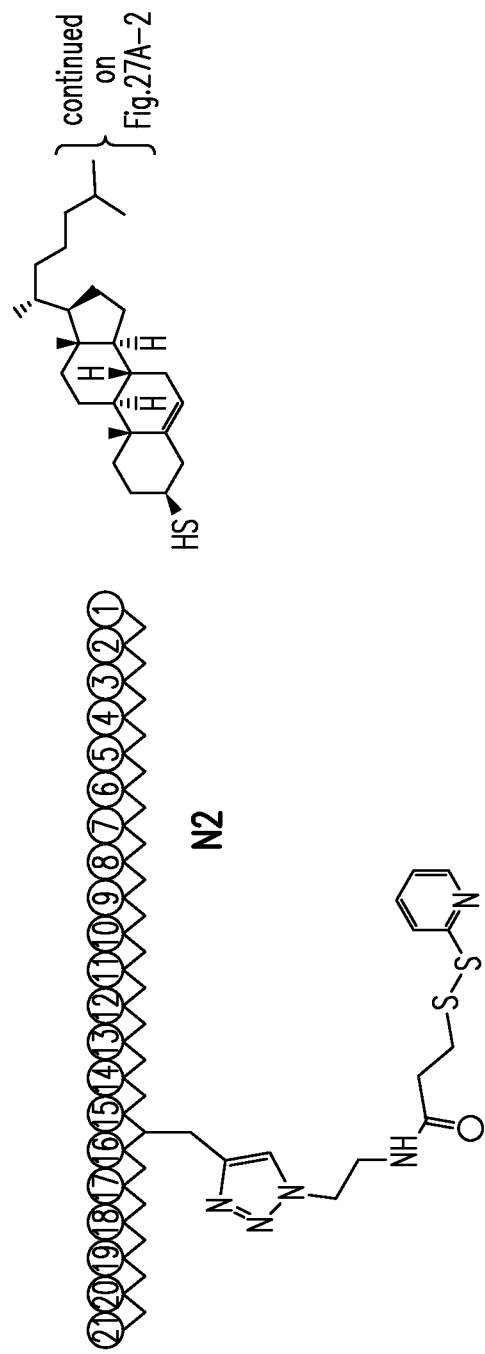
Figures 2, 27A:
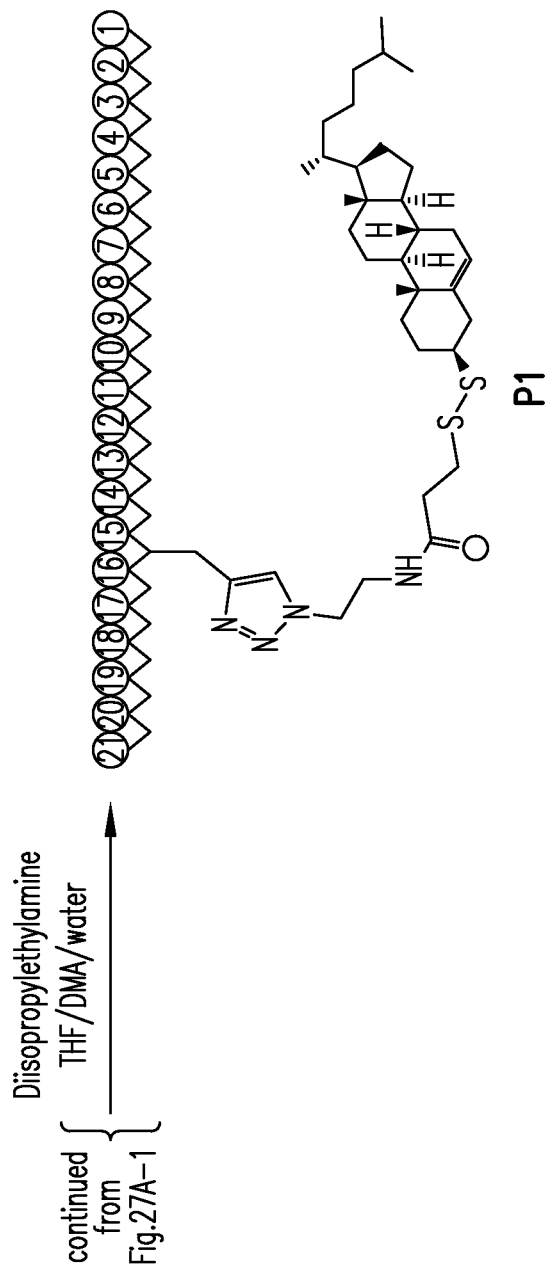
Figures 1, 27B:
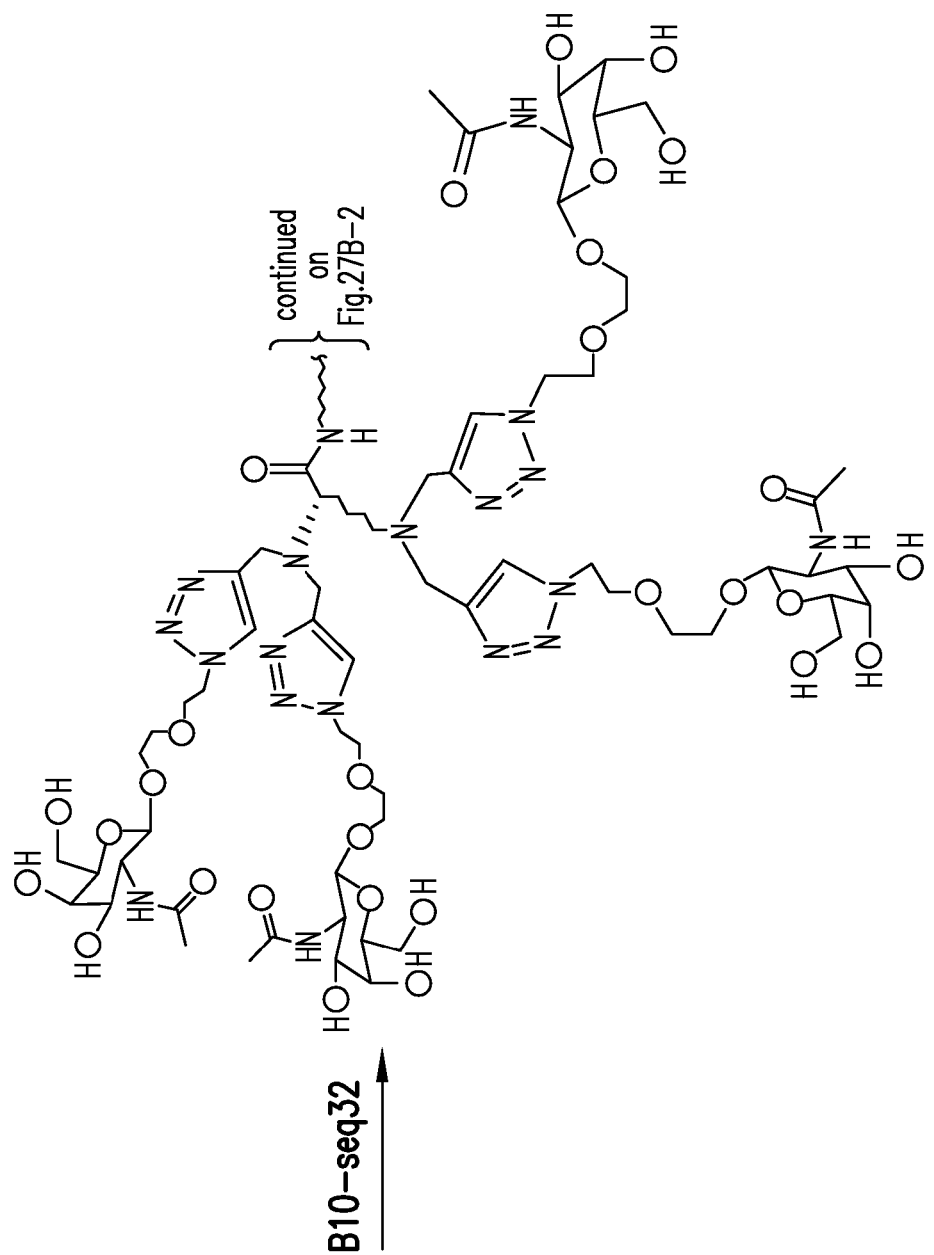
Figures 2, 27B:
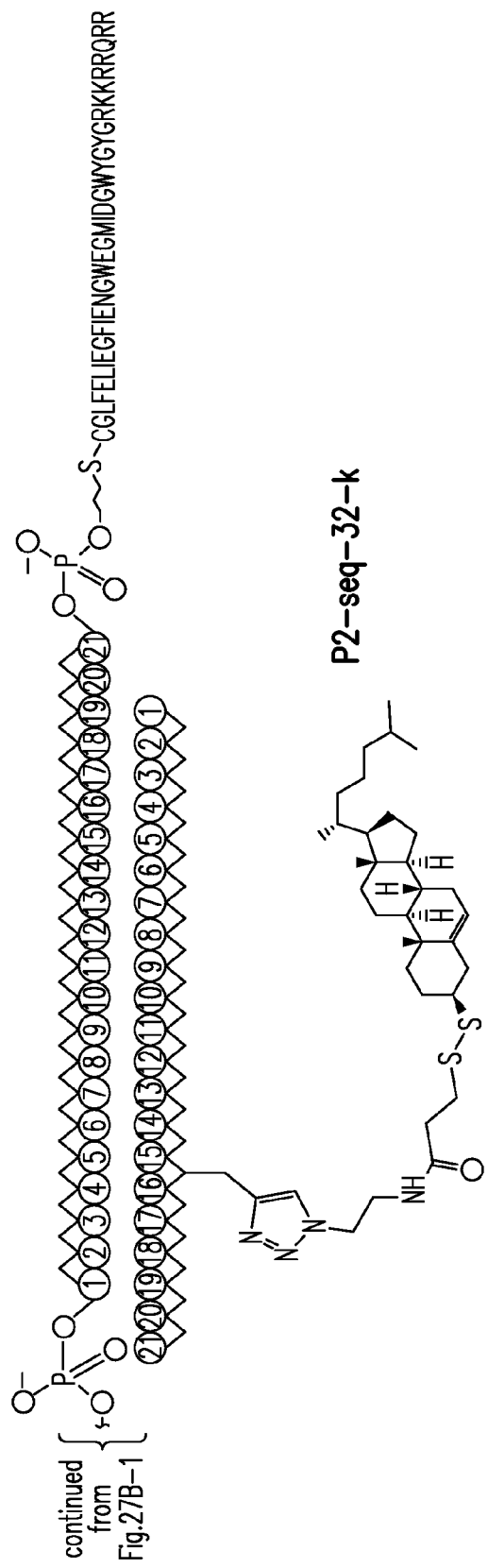

FIG. 25. Scheme 25 as shown in FIG. 25A to FIG. 25B-2 for preparing N4-seq 283-k compound. The figures disclose SEQ ID NO: 283.

FIG. 26. Scheme 26 as shown in FIG. 26A-1 to FIG. 26B-2 for preparing O3-seq 463-k compound. The figures disclose SEQ ID NO: 463.

FIG. 27. Scheme 27 as shown in FIG. 27A-1 to FIG. 27B-2 for preparing P2-seq-32-k compound. The figures disclose SEQ ID NO: 13.

Figures 1, 28:
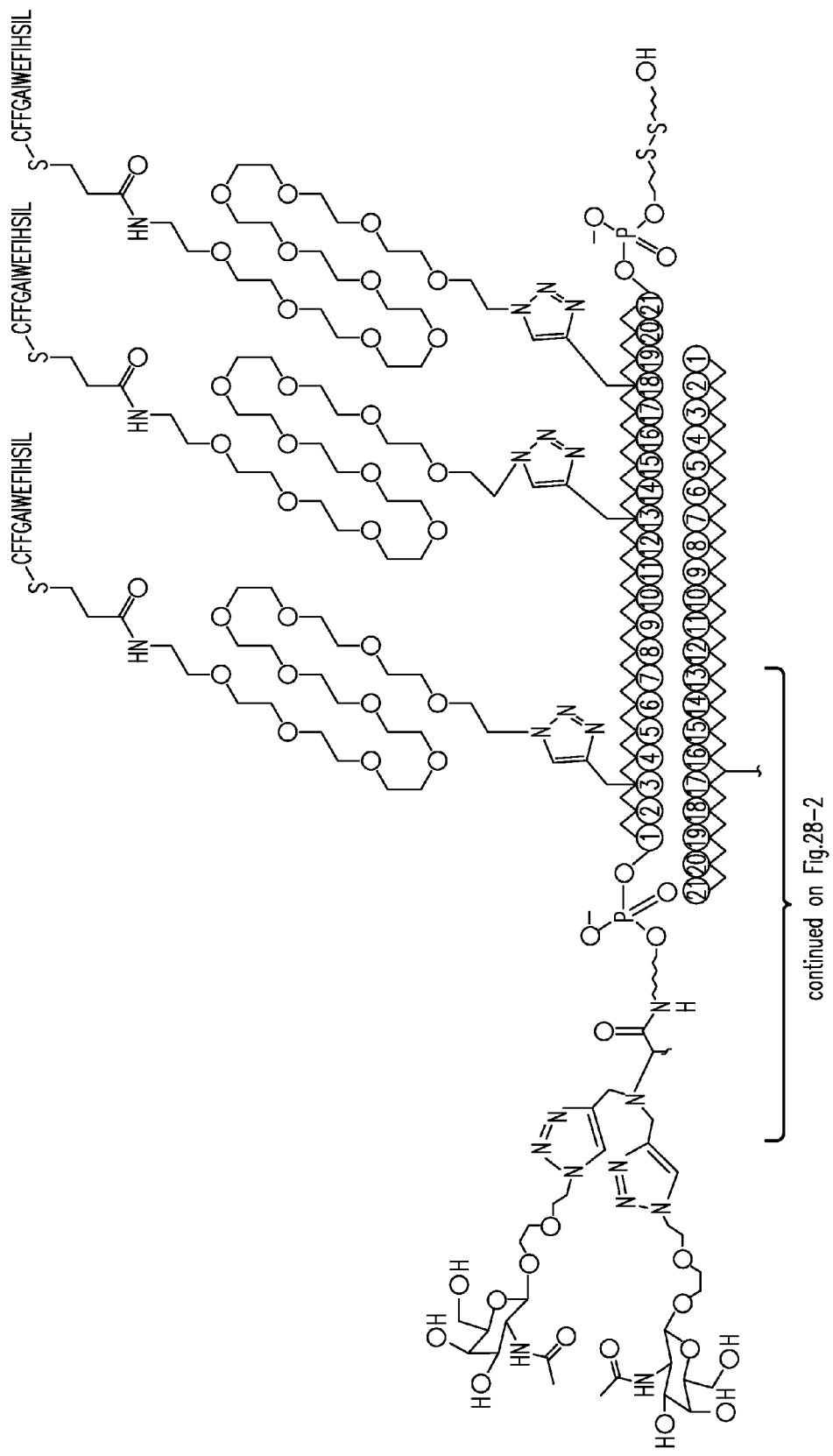
Figures 2, 28:
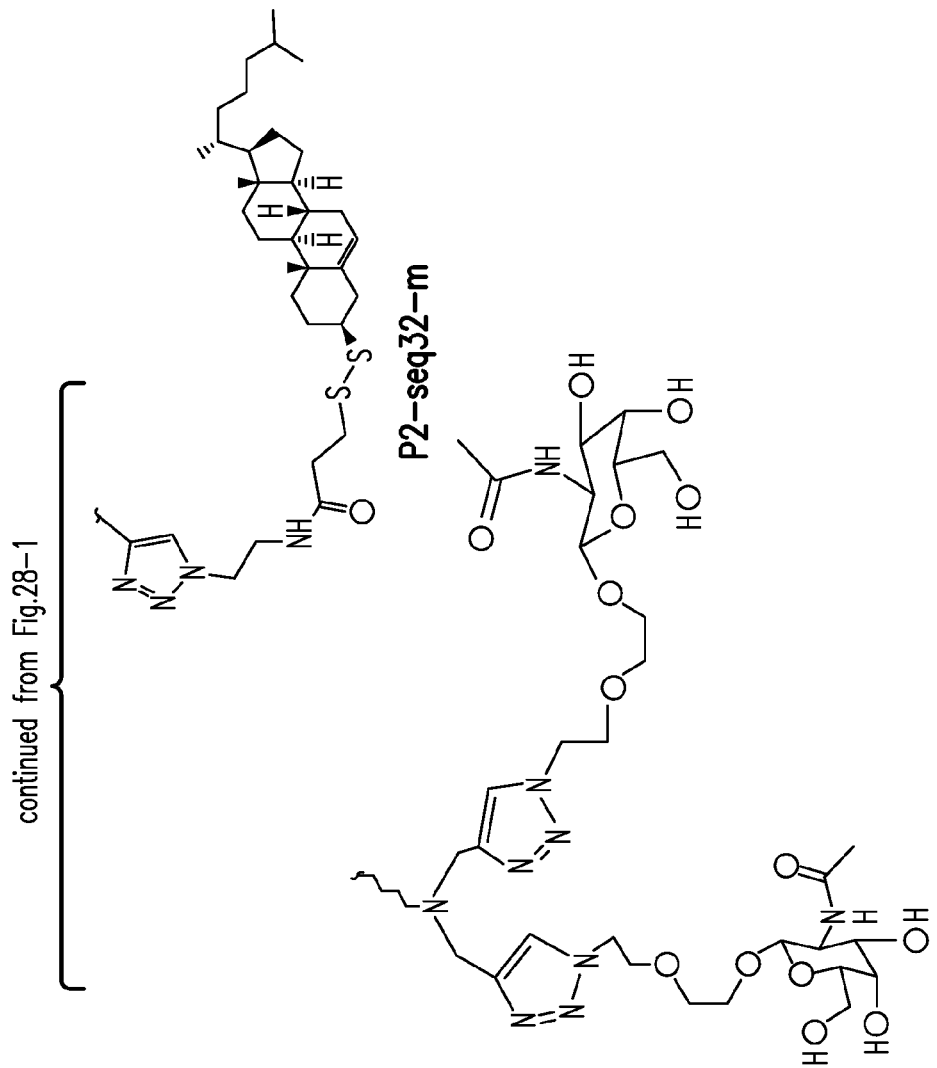
Figures 1, 29A:
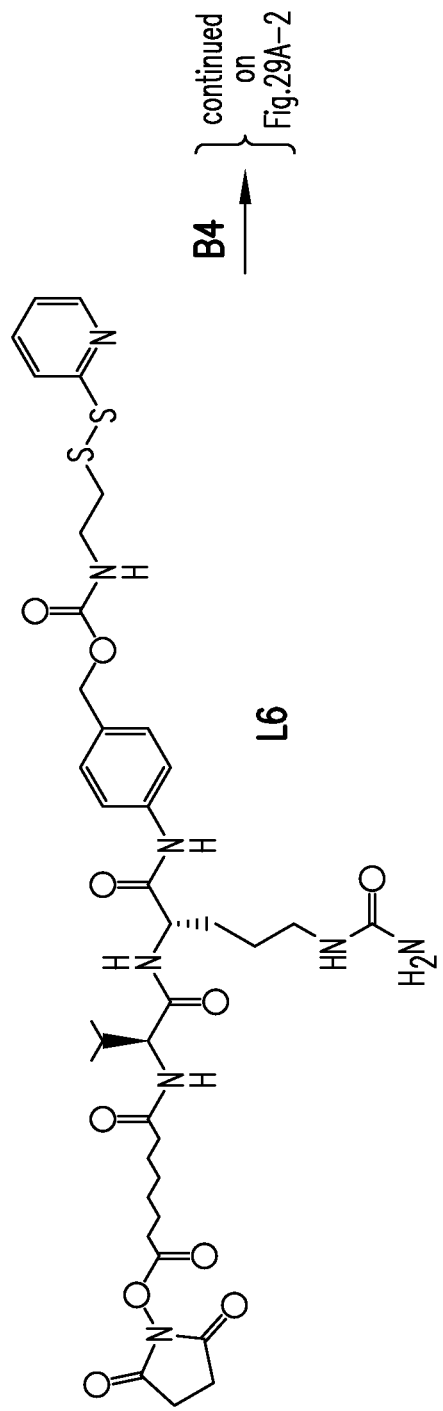
Figures 2, 29A:
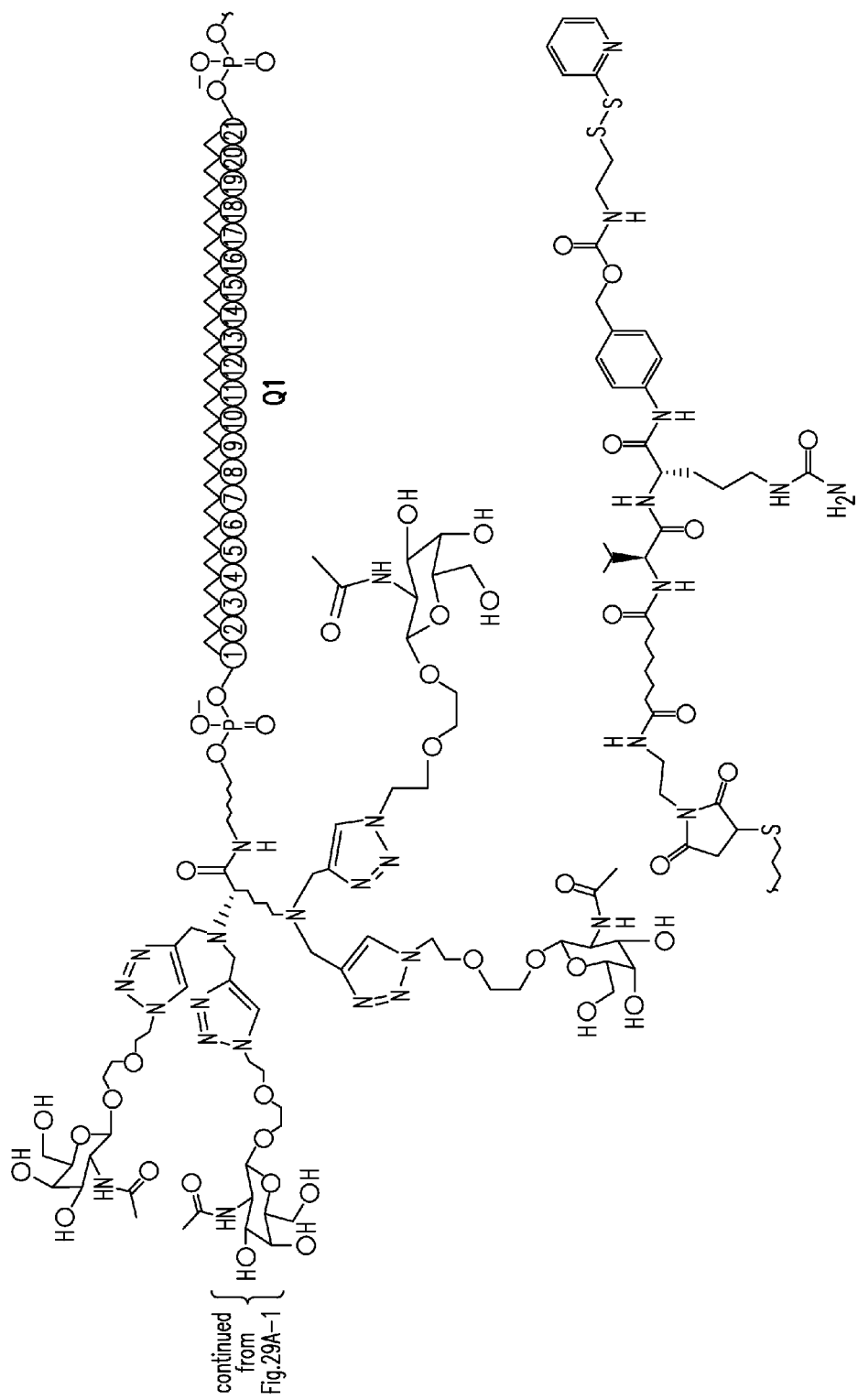
Figures 1, 29B:
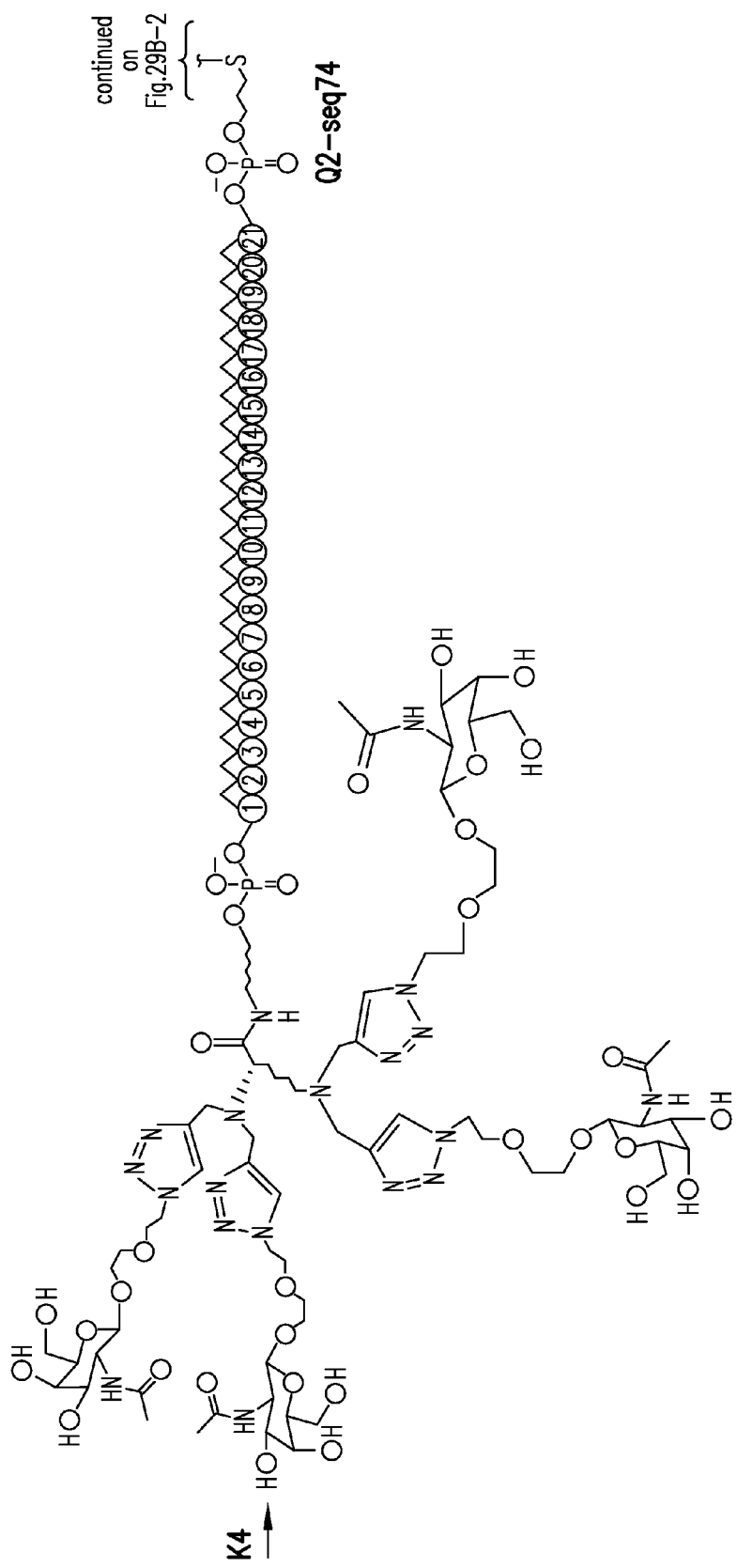
Figures 2, 29B:
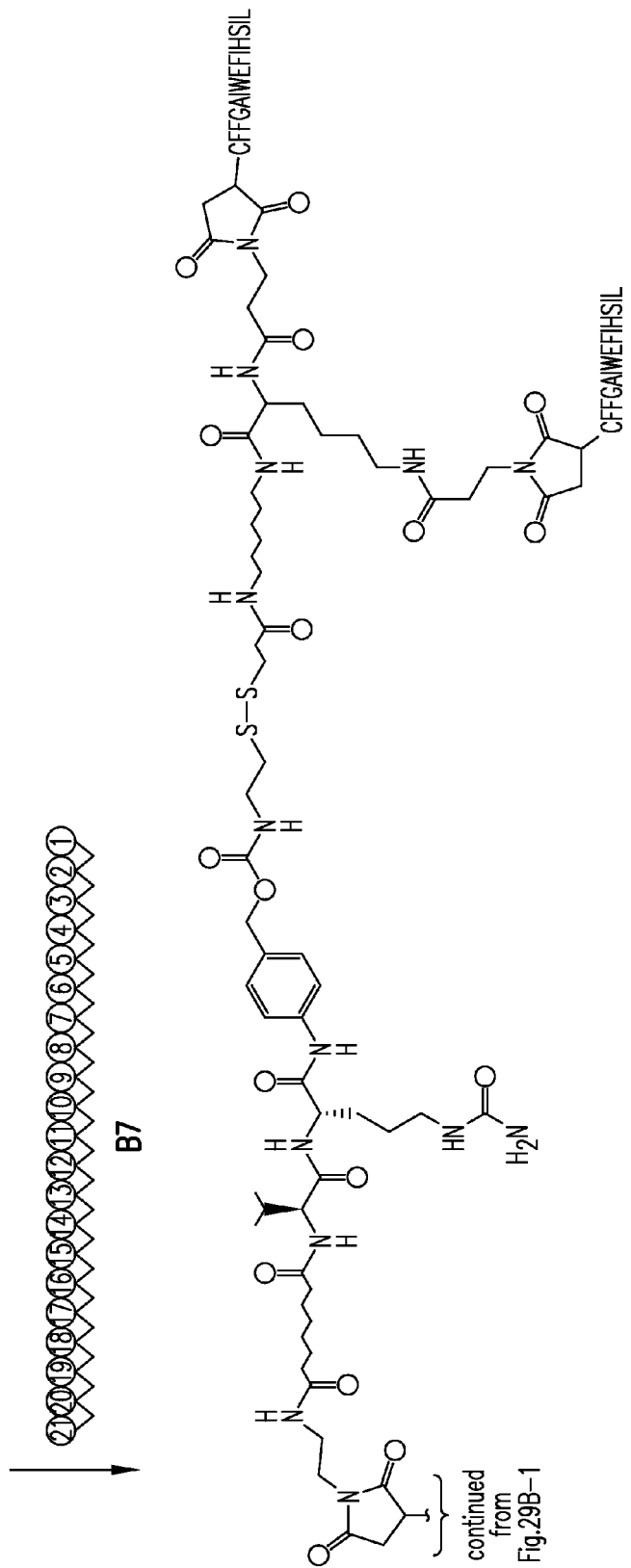
Figures 1, 29C:
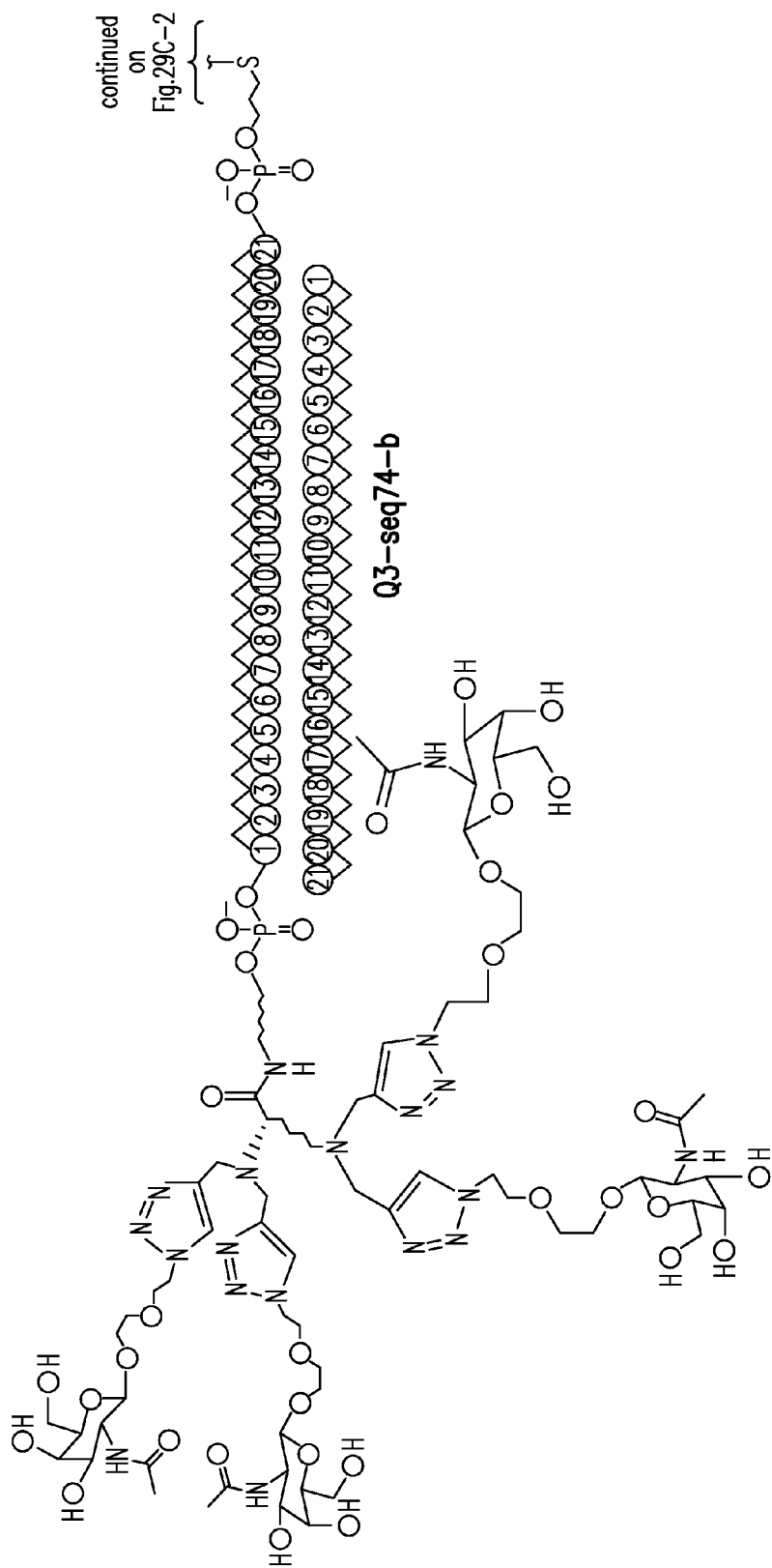
Figures 2, 29C:
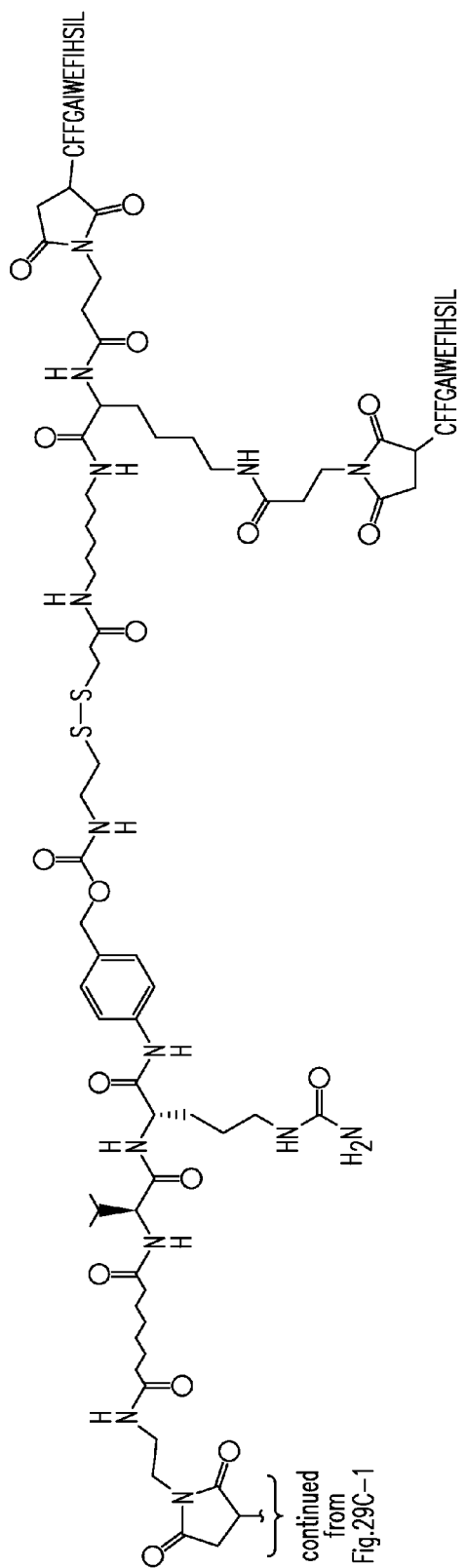
Figure 30A:
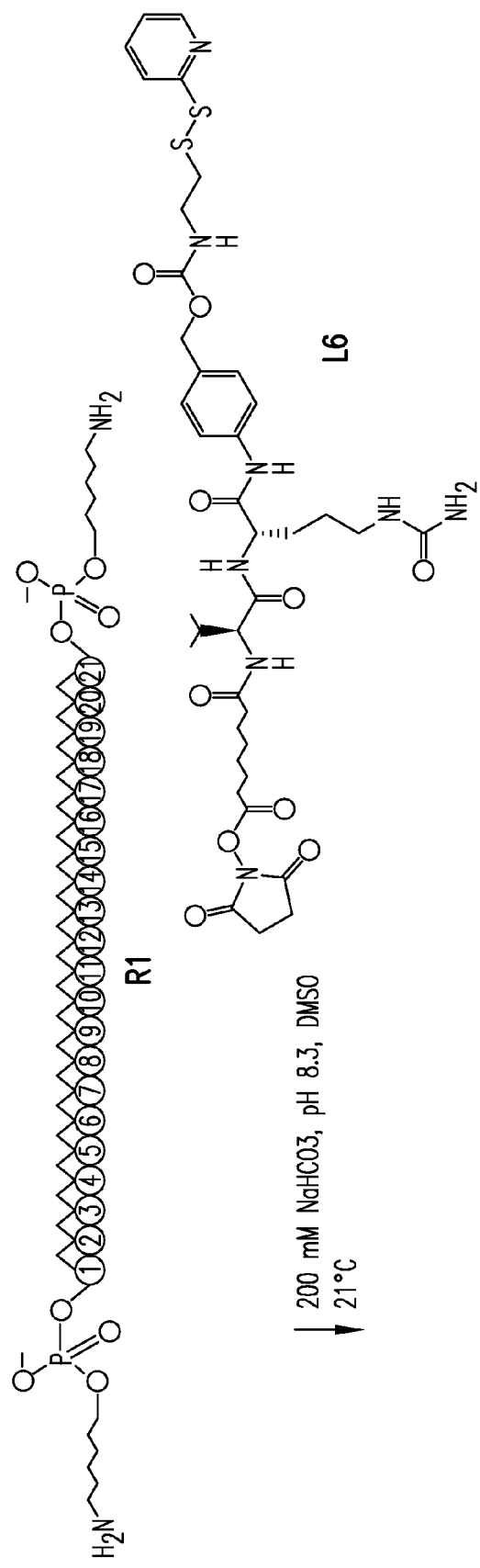
Figures 1, 30B:
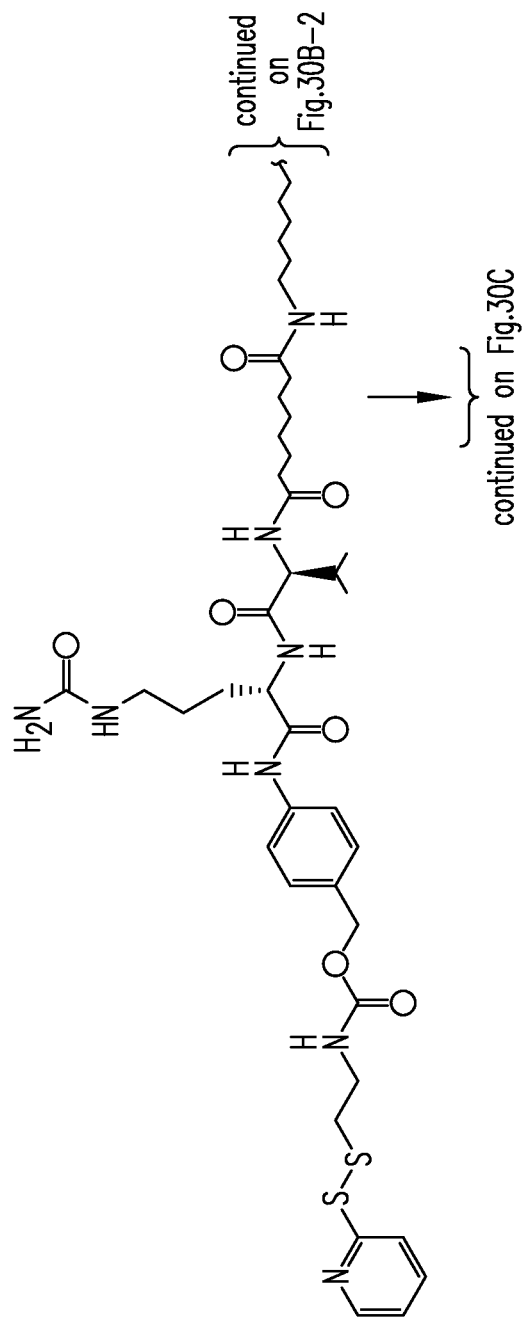
Figures 2, 30B:
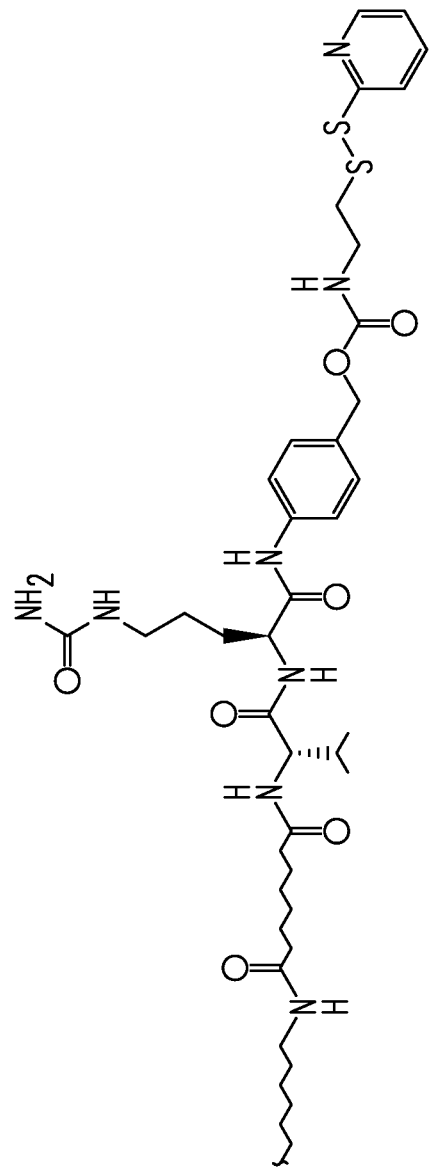
Figures 1, 30D:
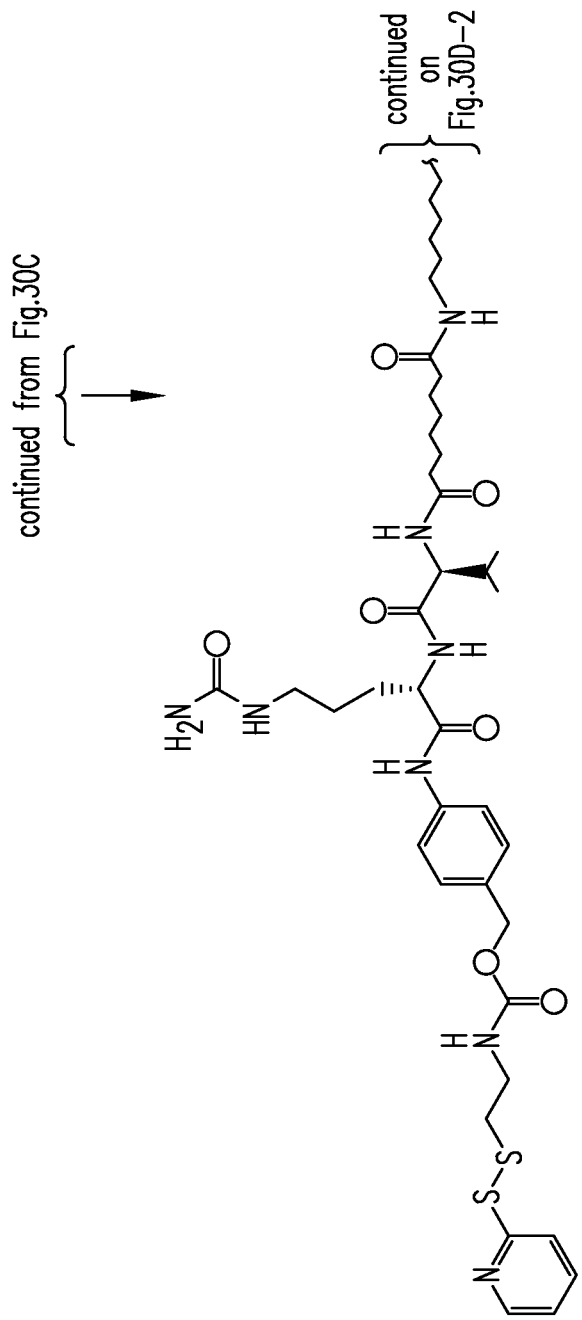
Figures 2, 30D:
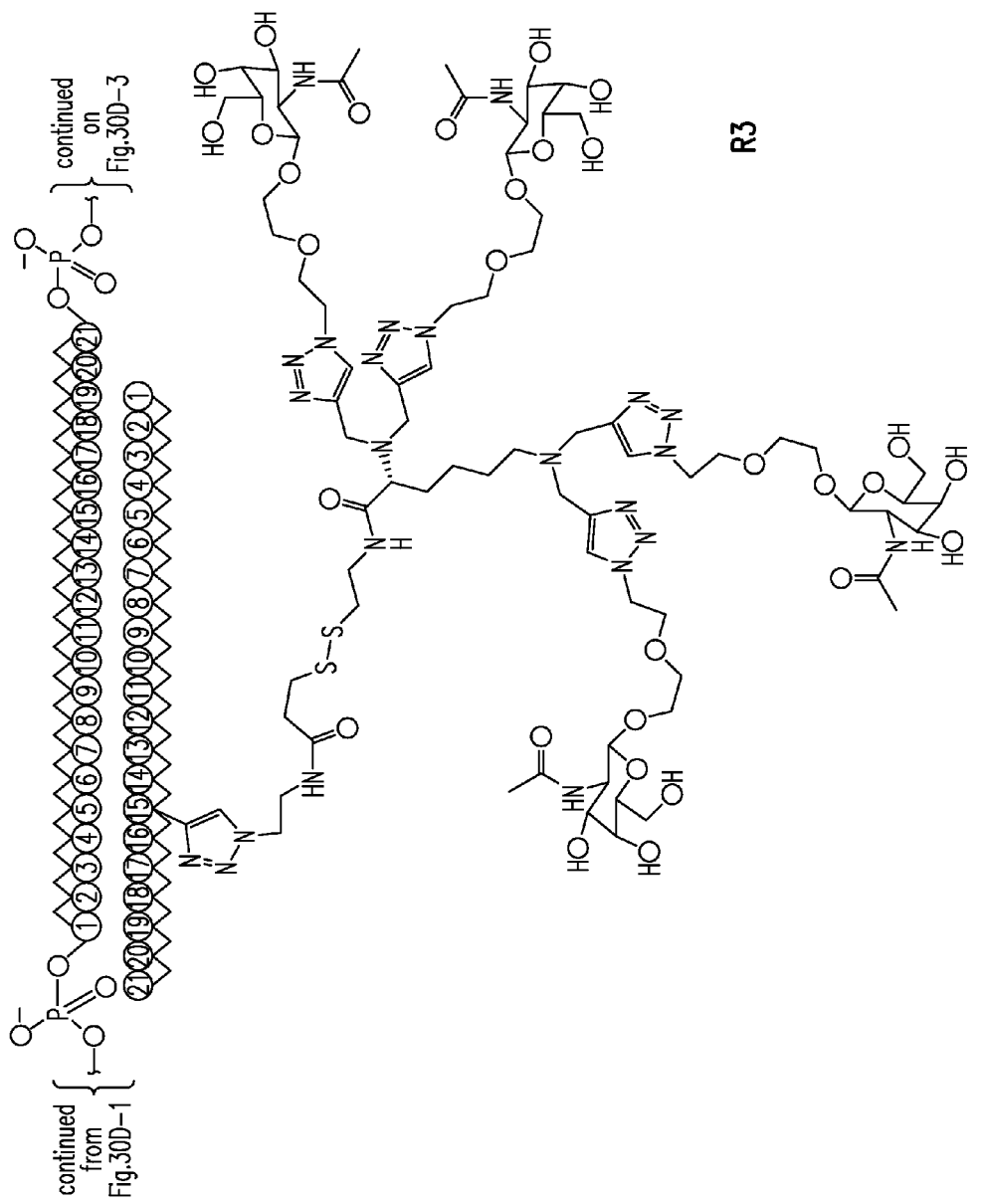
Figures 3, 30D:
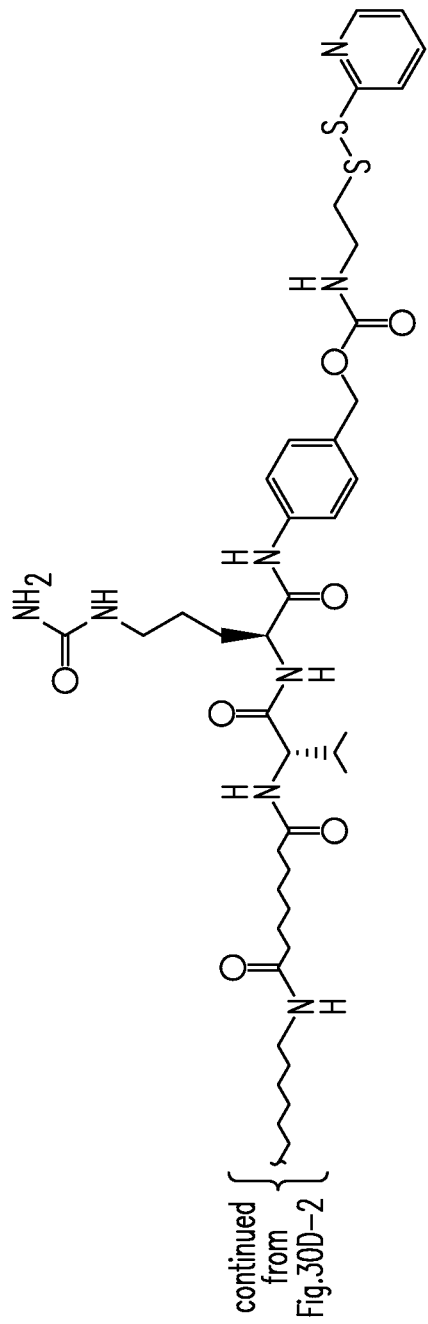
Figures 2, 30E:
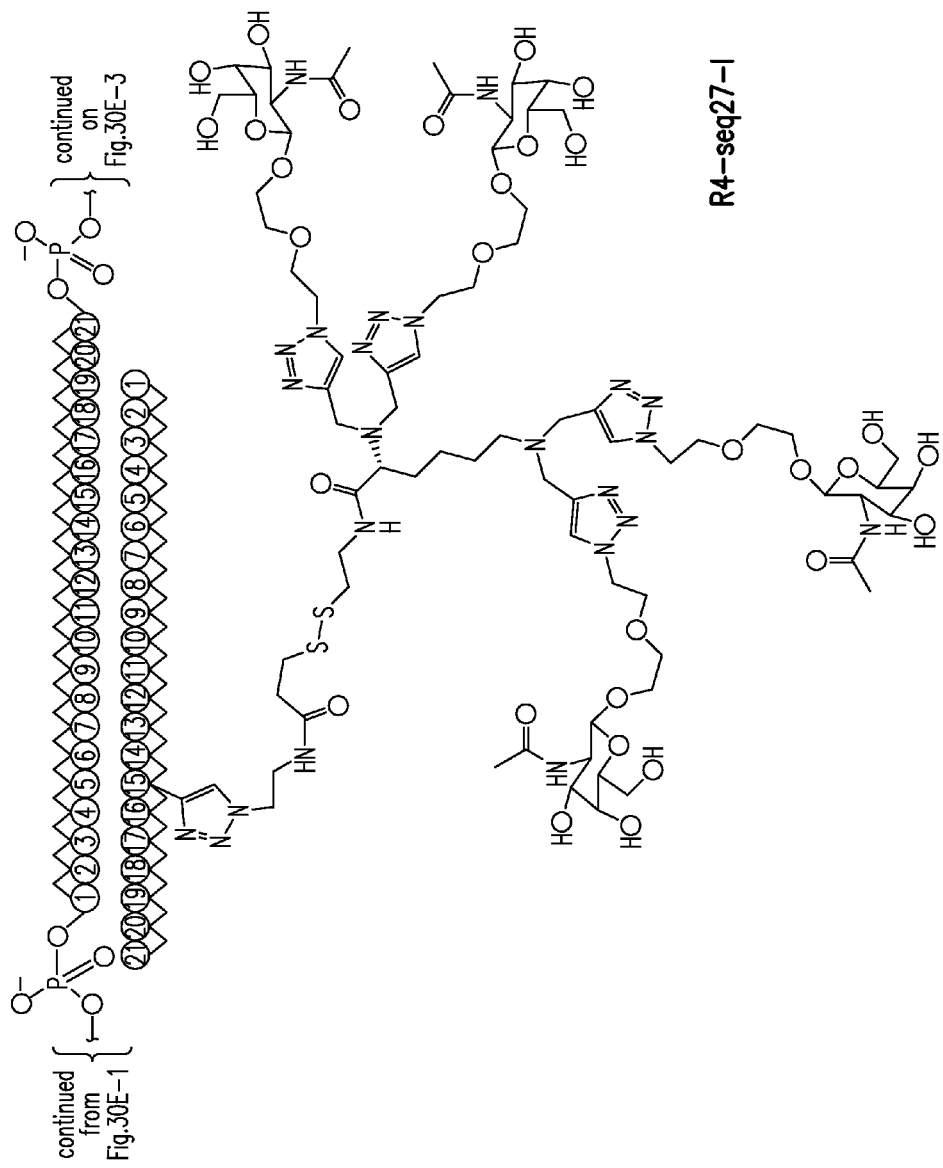
Figures 3, 30E:
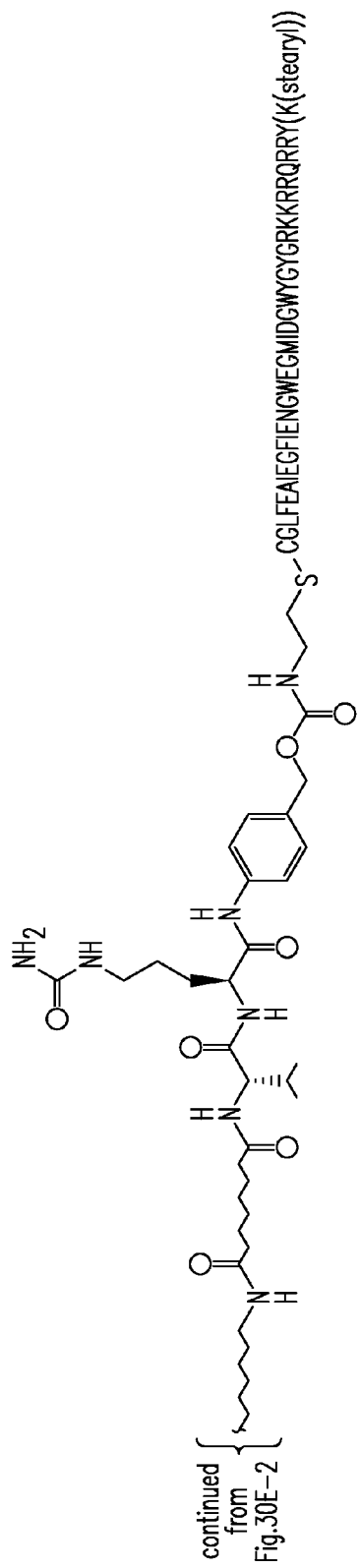

FIG. 28. Scheme 28 as shown in FIG. 28-1 to FIG. 28-2 for preparing P2-seq 32-m compound. The figures disclose SEQ ID NO: 74.

FIG. 29. Scheme 29 as shown in FIG. 29A-1 to FIG. 29C-2 used to prepare Q3-seq74-b compound. The figures disclose SEQ ID NO: 74.

FIG. 30. Scheme 30 as shown in FIG. 30A to FIG. 30E-3 for preparing R4-seq 27-I compound. The figures disclose SEQ ID NO: 27.

Figure 31A:
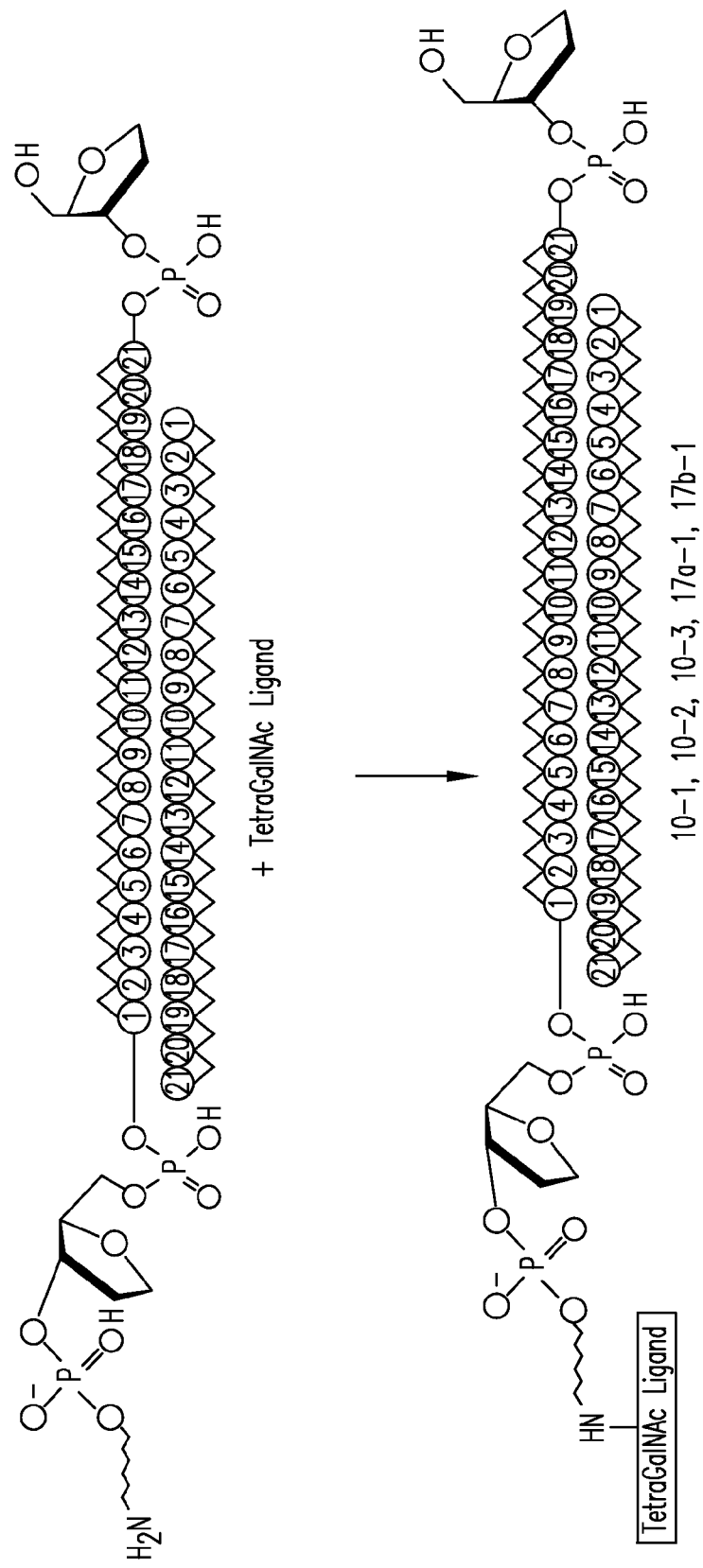
Figure 31B:
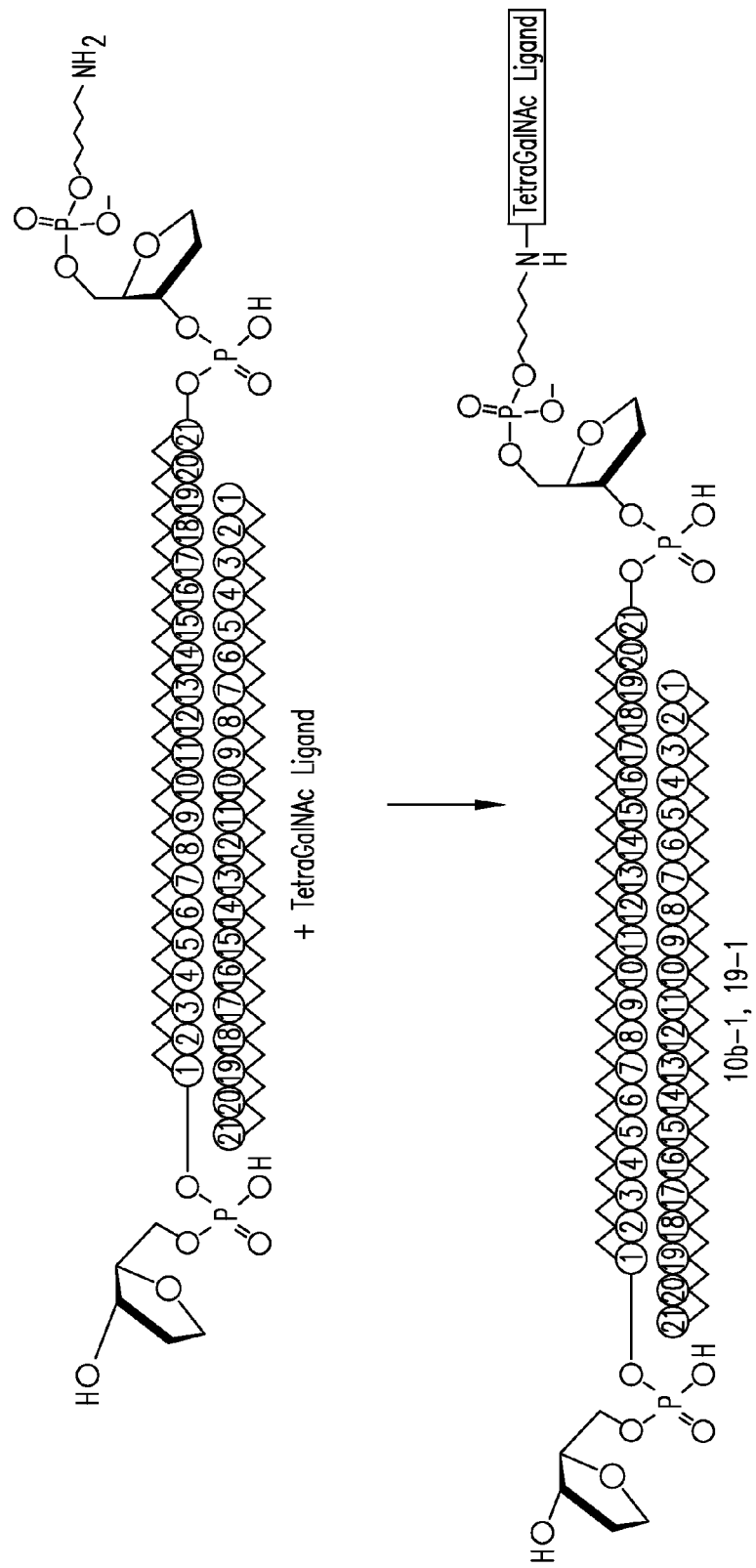

FIG. 31. Scheme 32 as shown in FIG. 31A and FIG. 31B for preparing tetraGalNAc-siRNA conjugates.

Figure 32A:
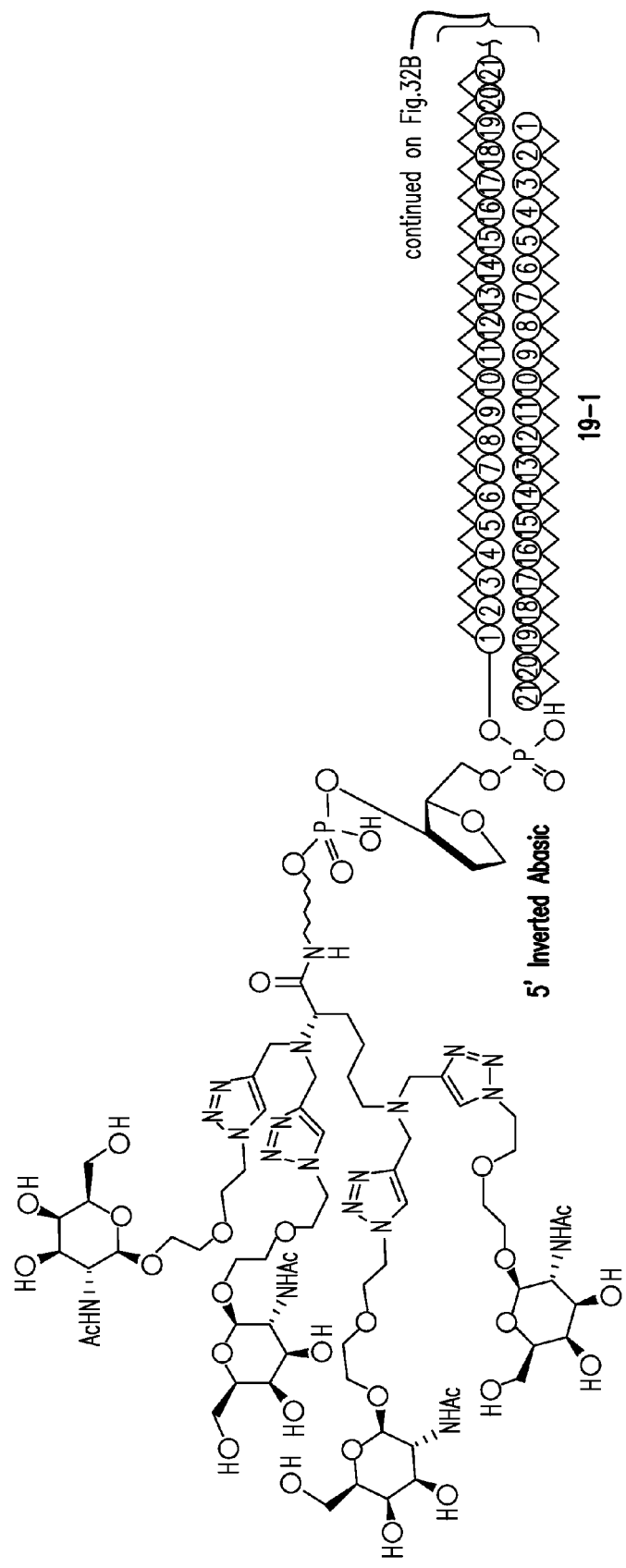
Figure 32B:
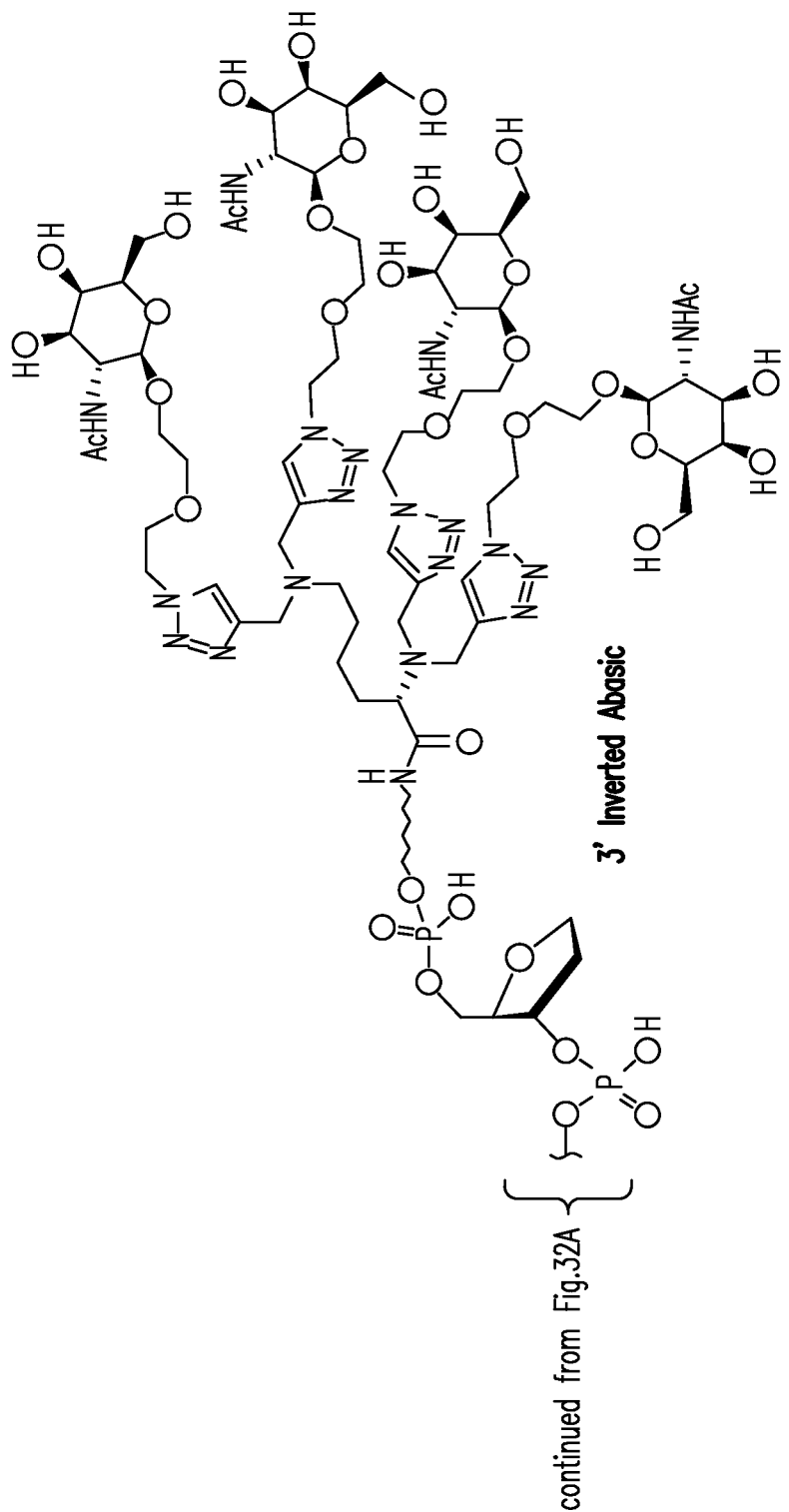

FIG. 32. Scheme 33 as shown in FIG. 32A and FIG. 32B for preparing TetraGalNAc-siRNA Conjugate 19-1.

Figure 33A:
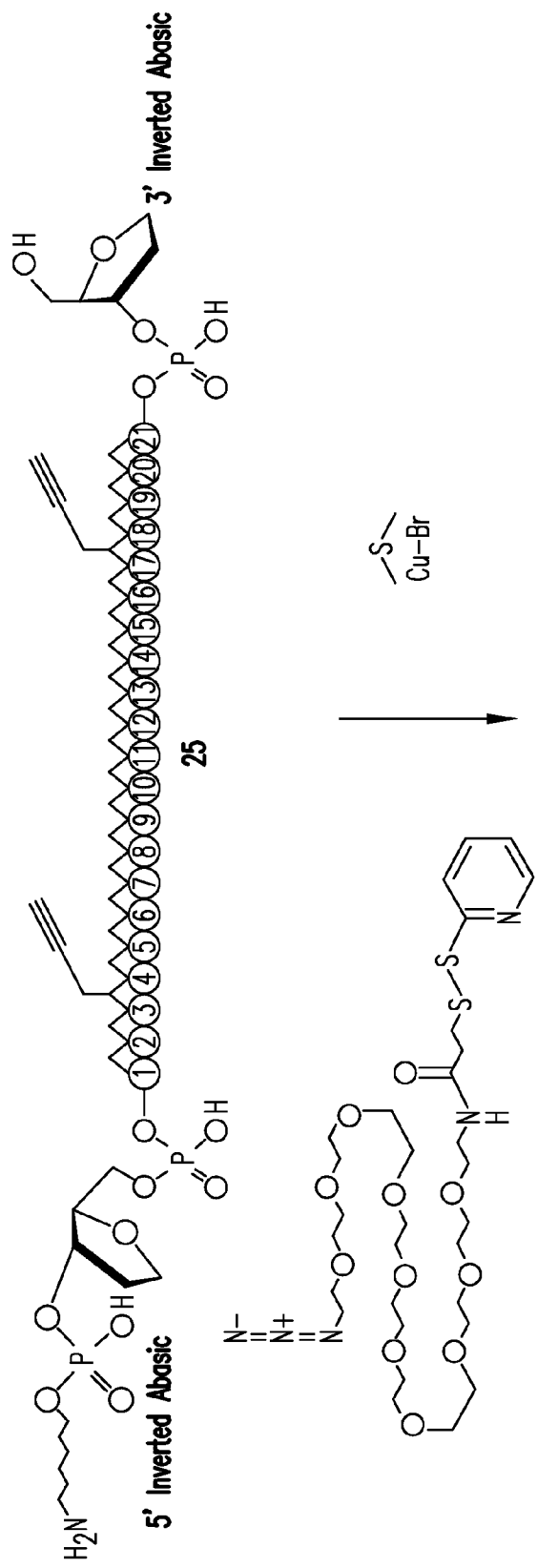
Figure 33B:
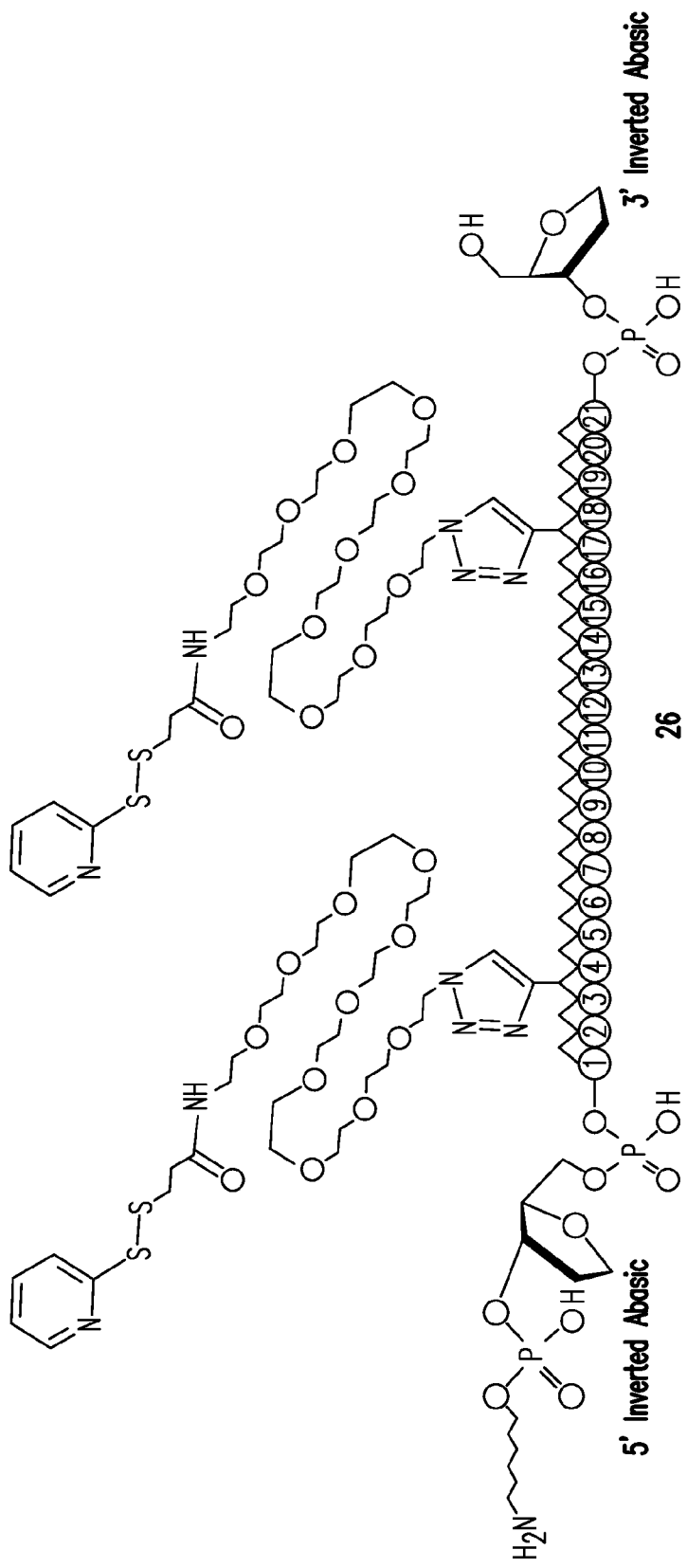

FIG. 33. Scheme 35 as shown in FIG. 33A and FIG. 33B for preparing Compound 26.

Figure 34A:
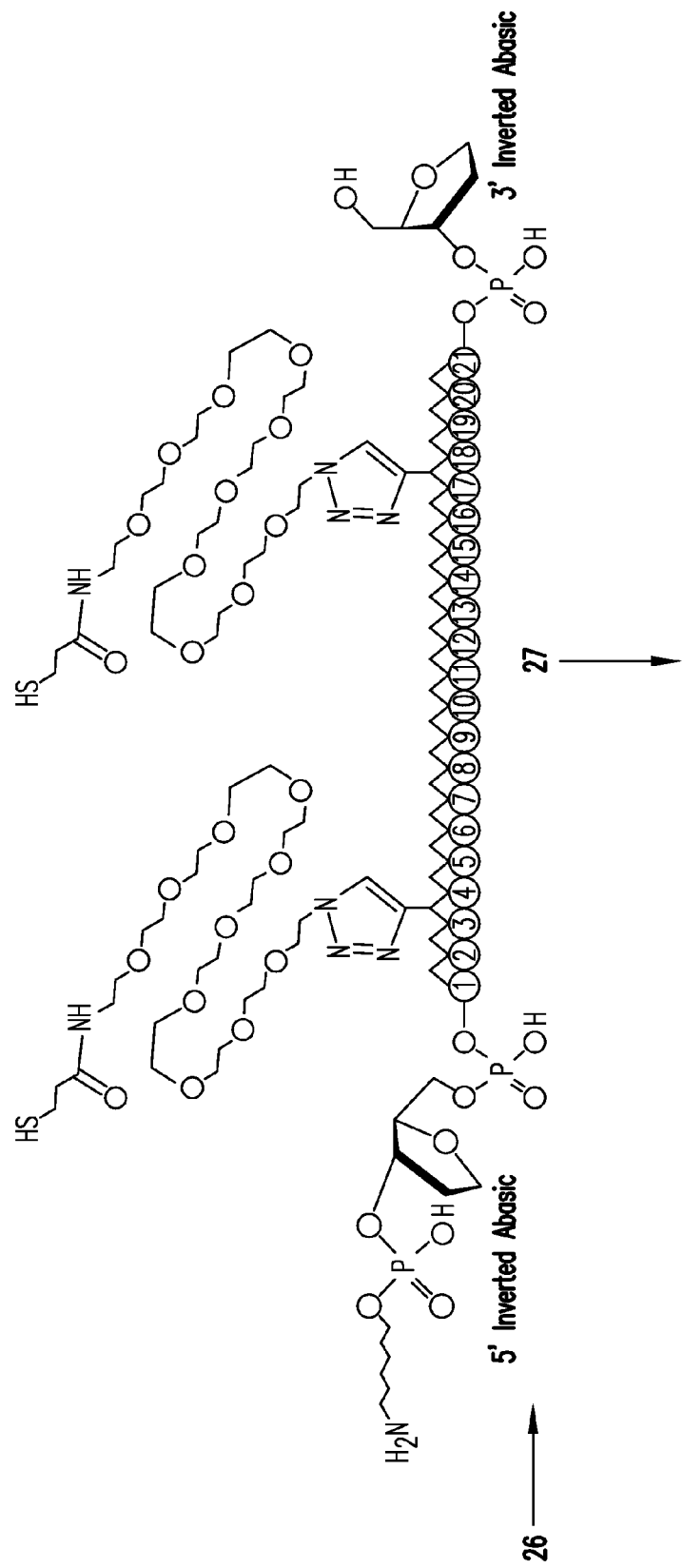
Figure 34C:
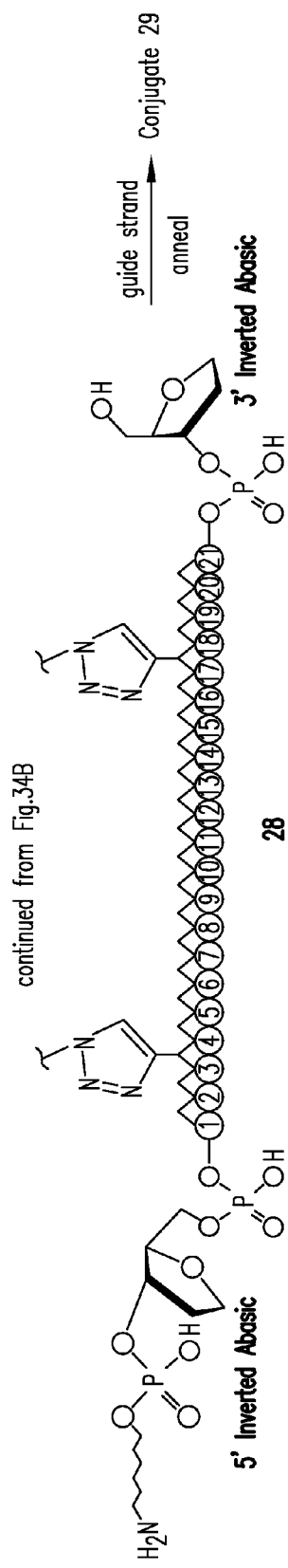

FIG. 34. Scheme 36 as shown in FIG. 34A to FIG. 34C for preparing Compounds 27 and 28.

Figure 35A:
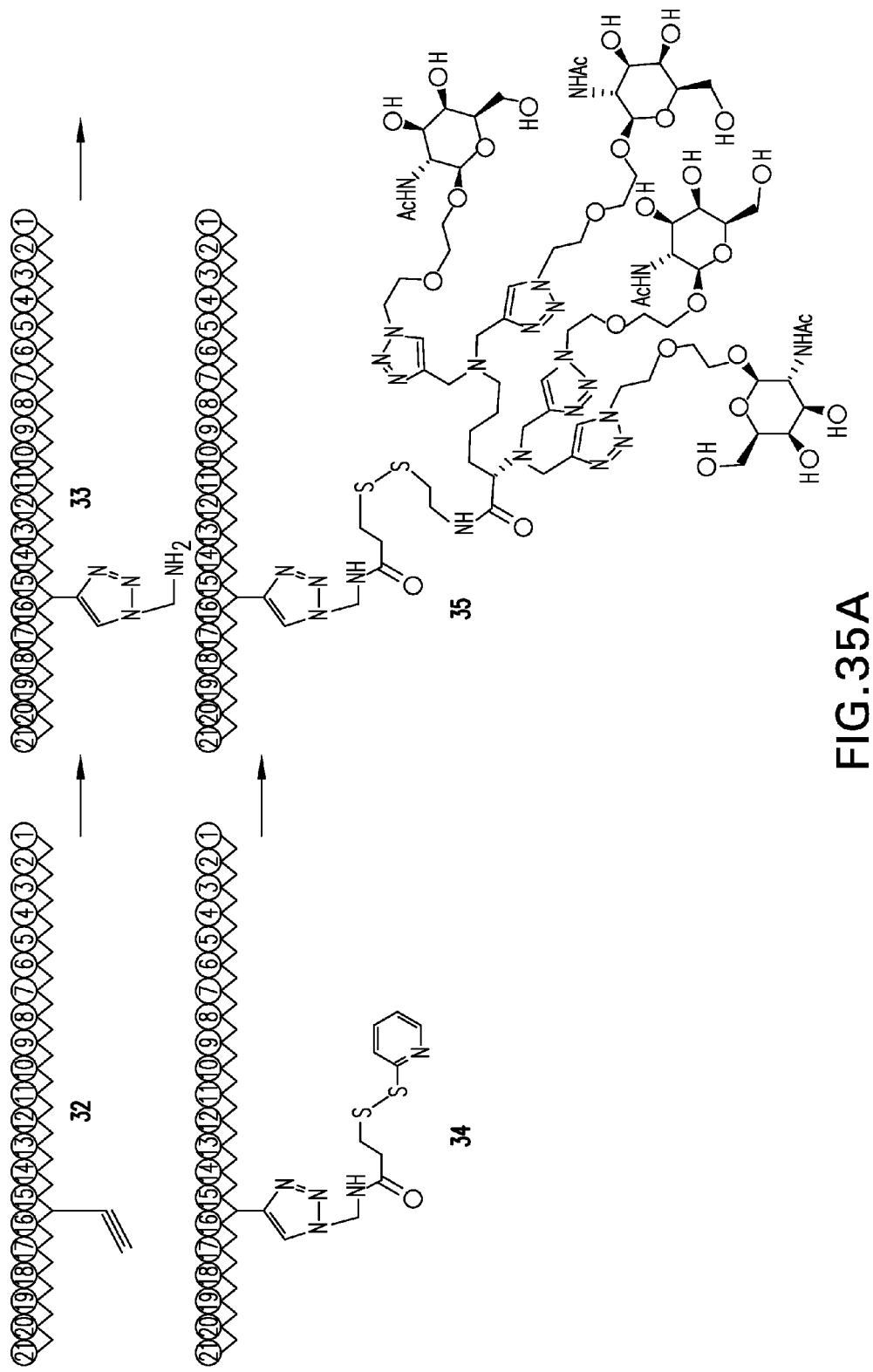
Figure 35B:
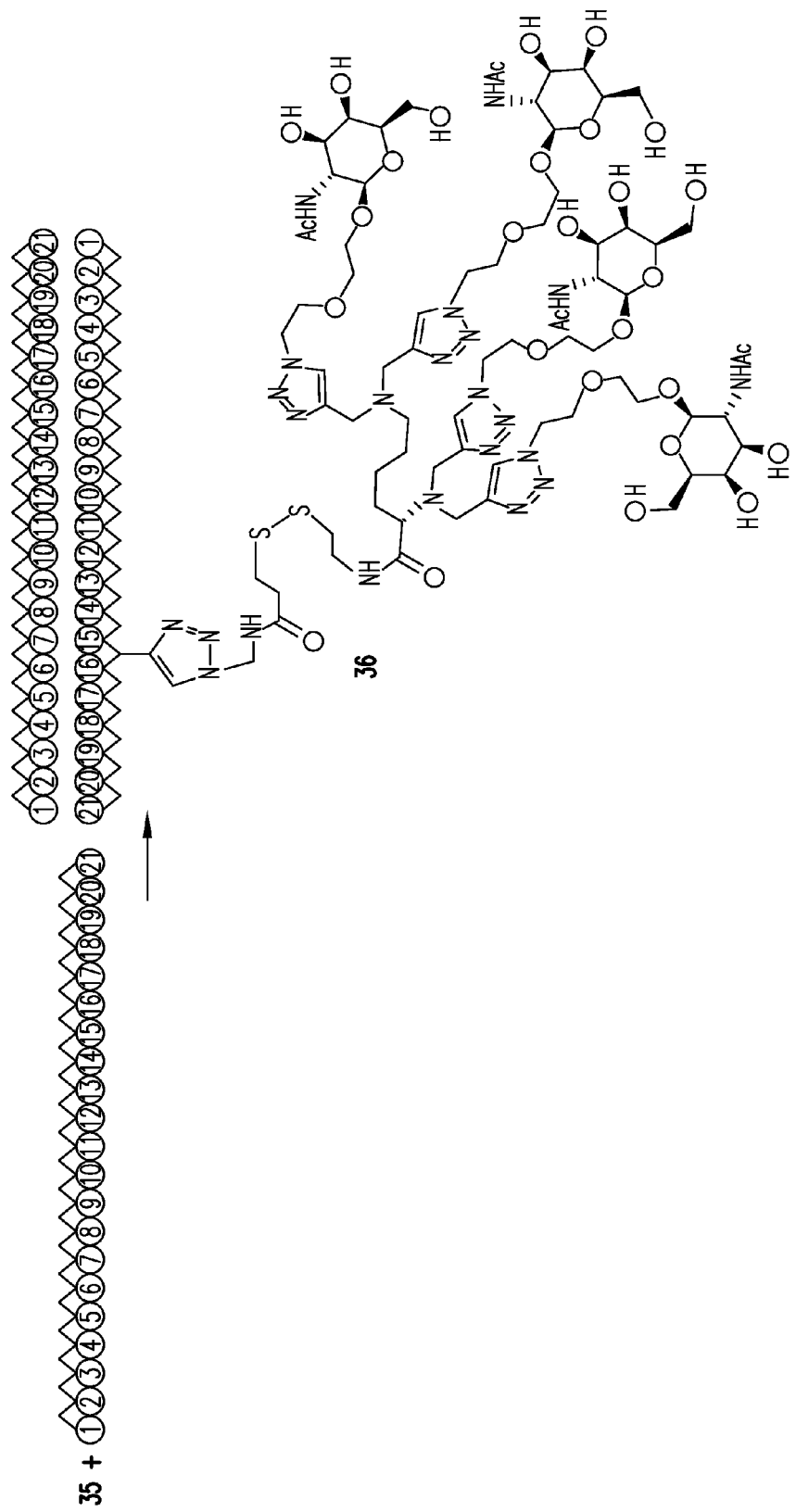

FIG. 35. Scheme 38 as shown in FIG. 35A and FIG. 35B for preparing Conjugates 35-37.

Figure 36A:
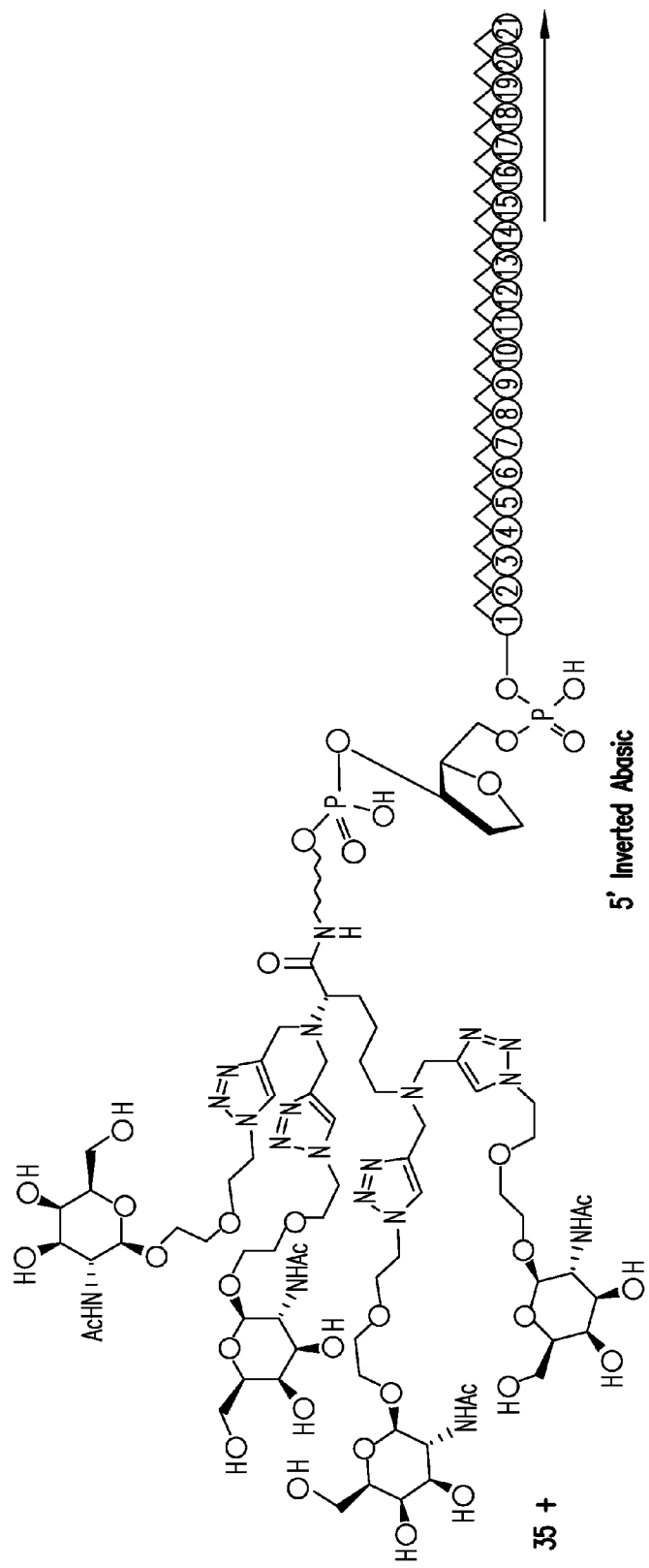
Figure 36B:
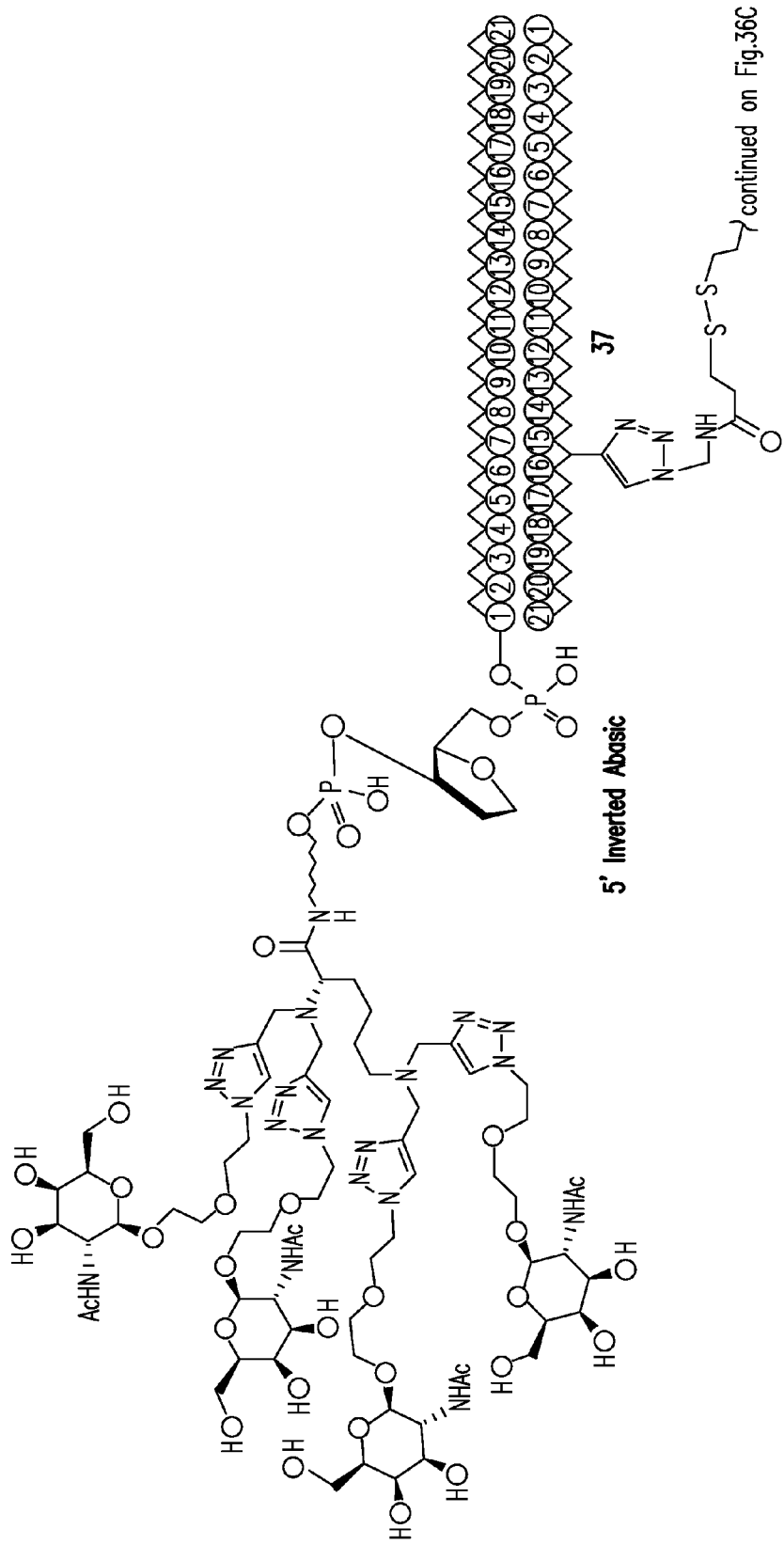
Figure 36C:
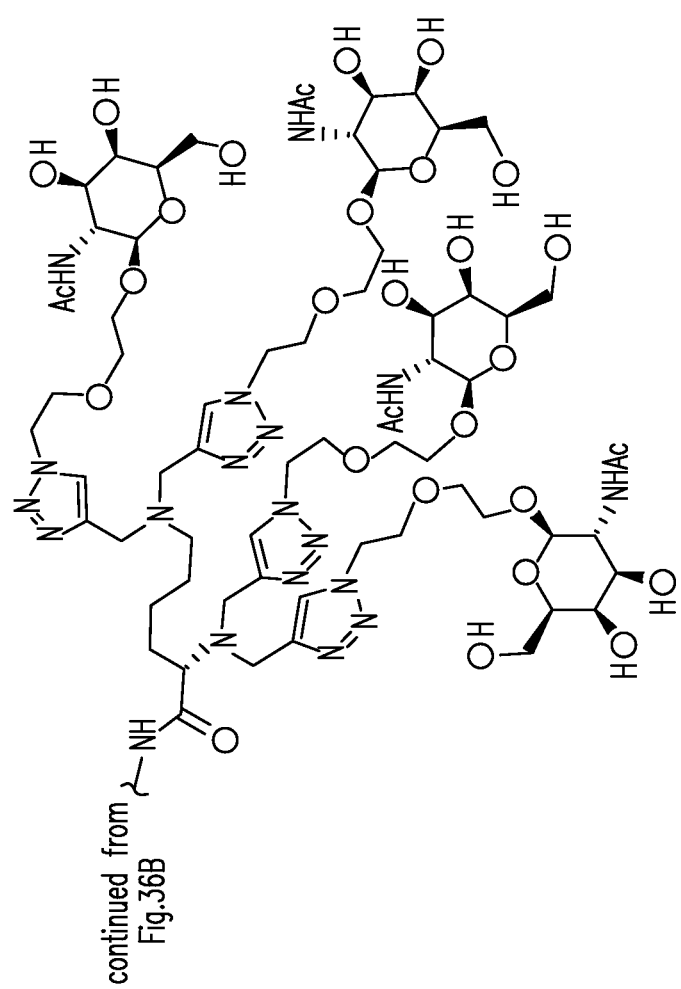

FIG. 36. Scheme 39 as shown in FIG. 36A to FIG. 36C for preparing Conjugates 38-44.

Figure 37:
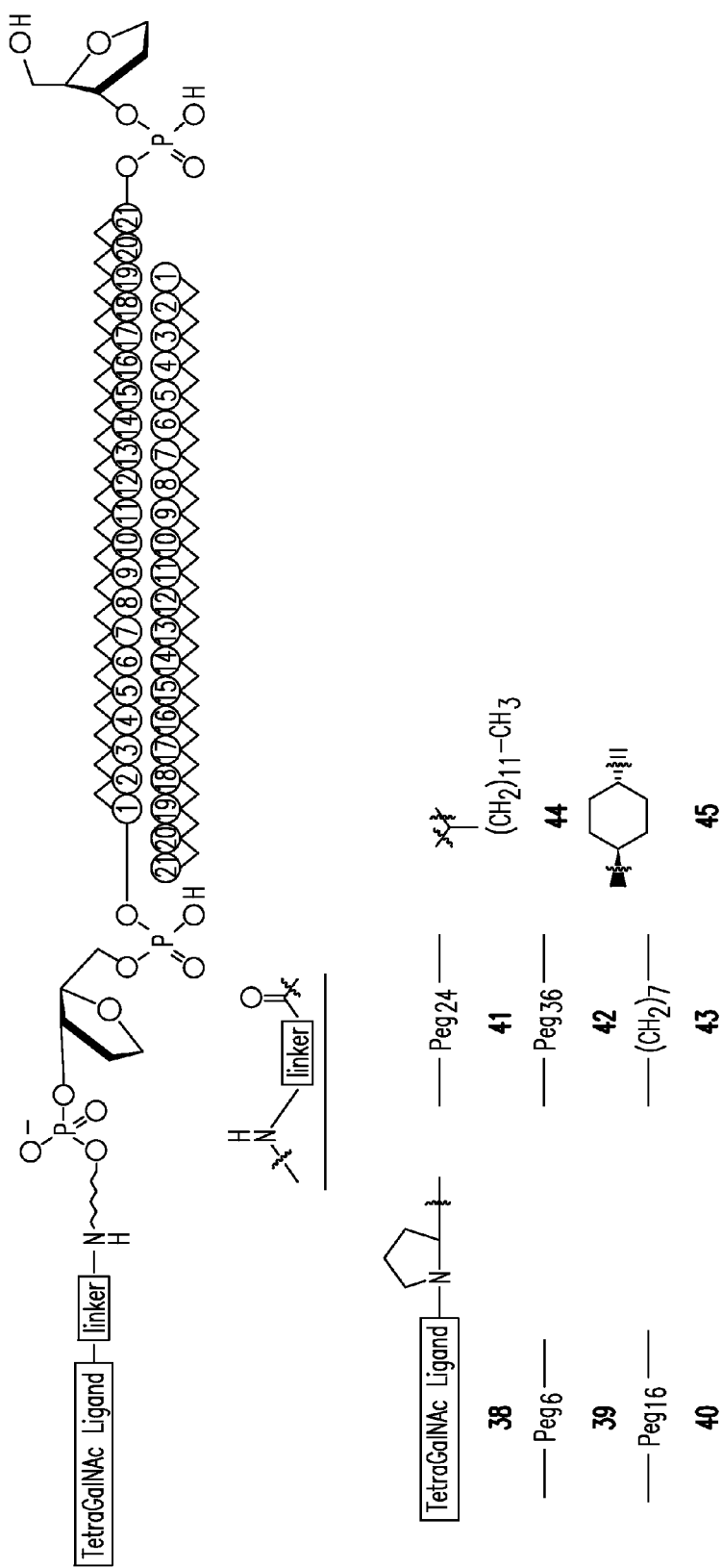
Figure 38A:
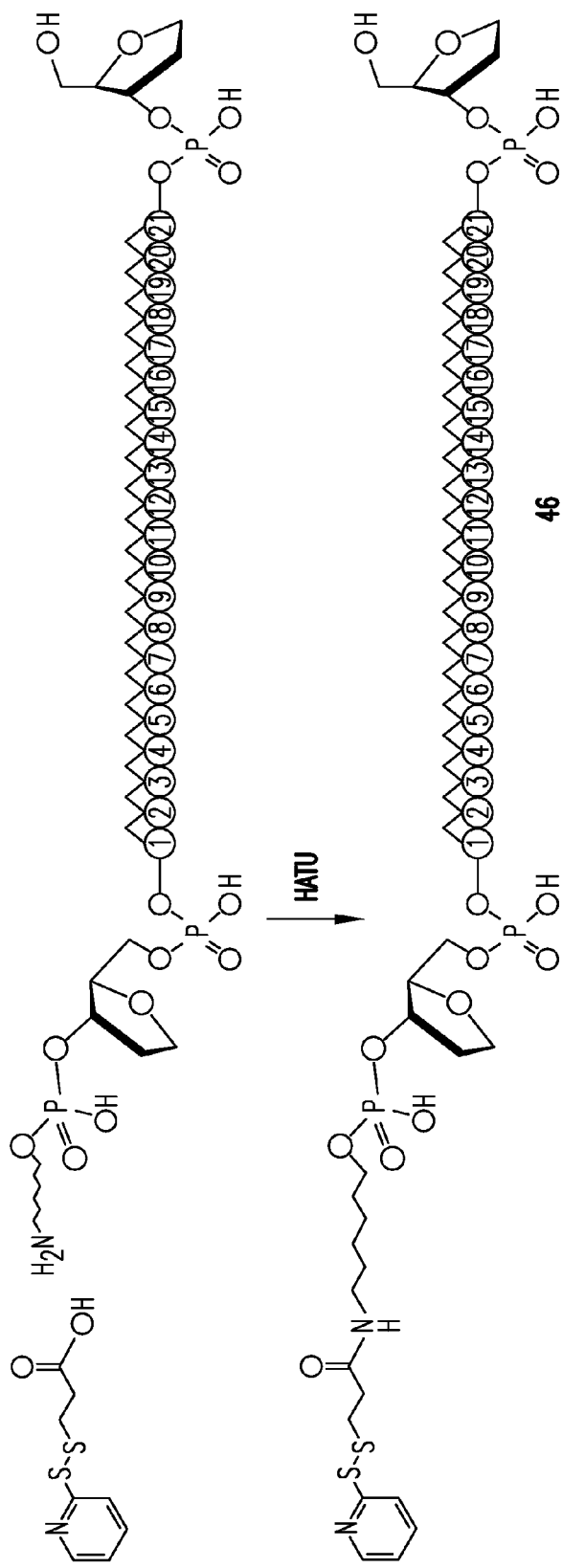
Figure 38B:
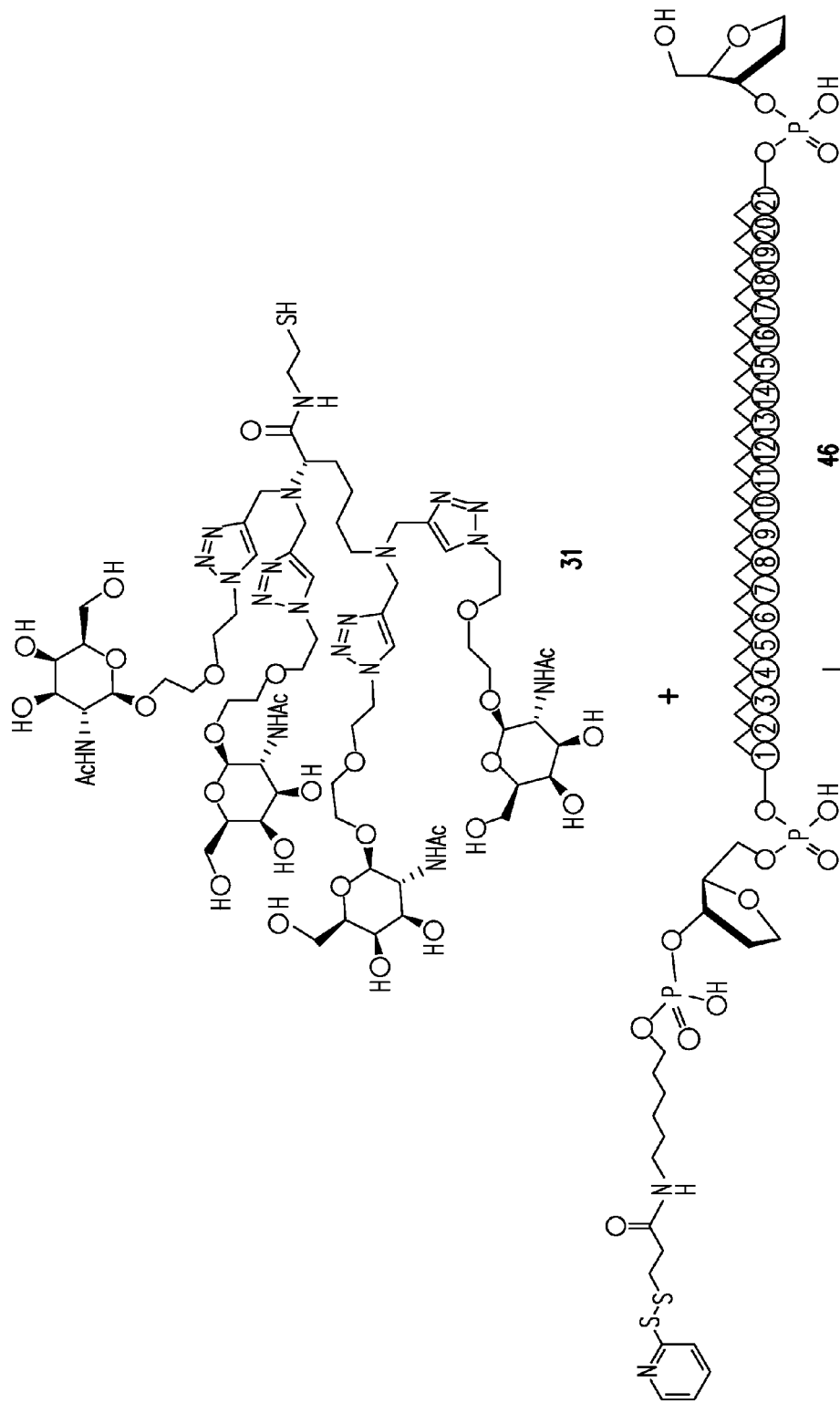
Figure 38C:
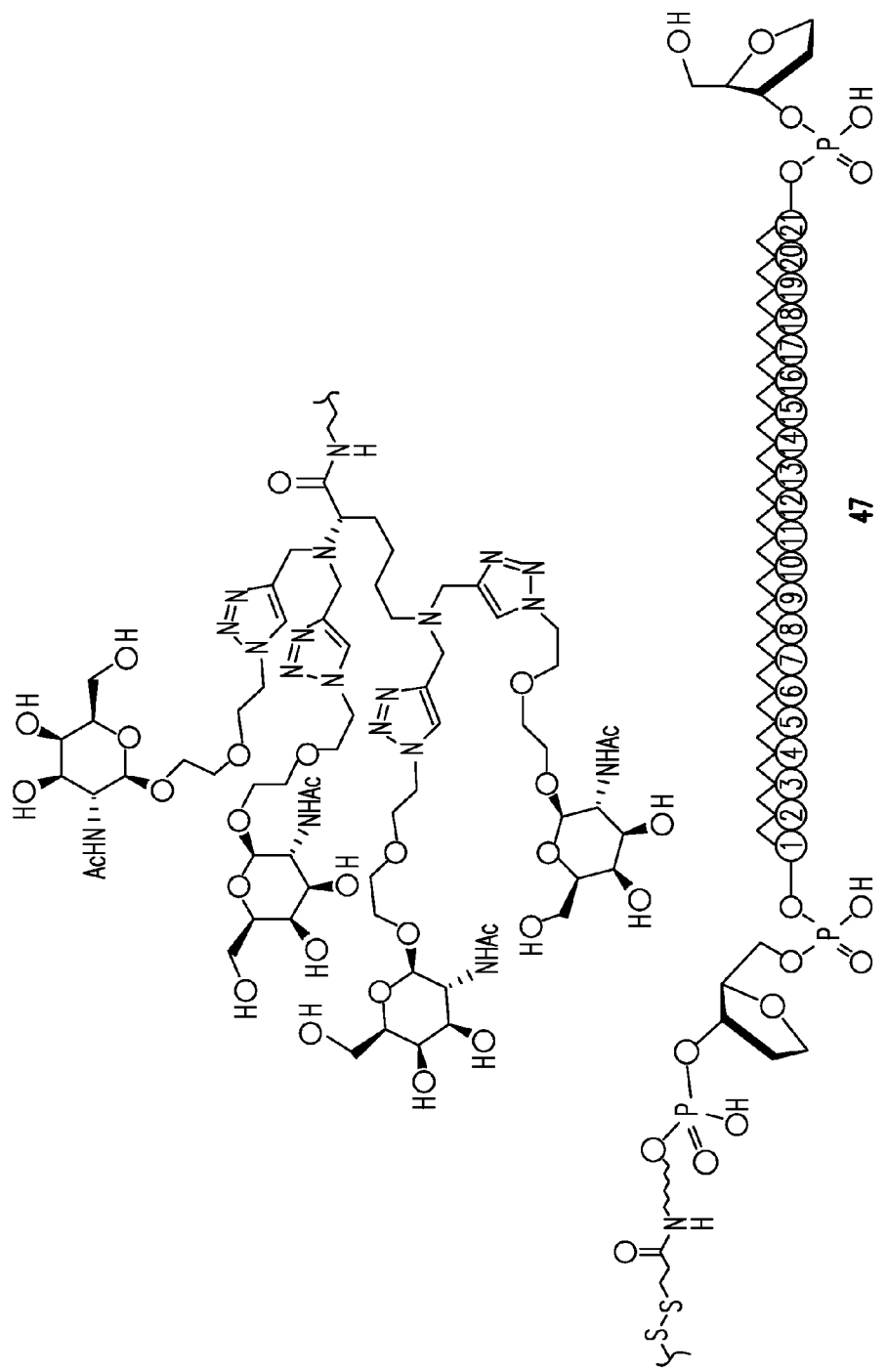
Figure 38D:
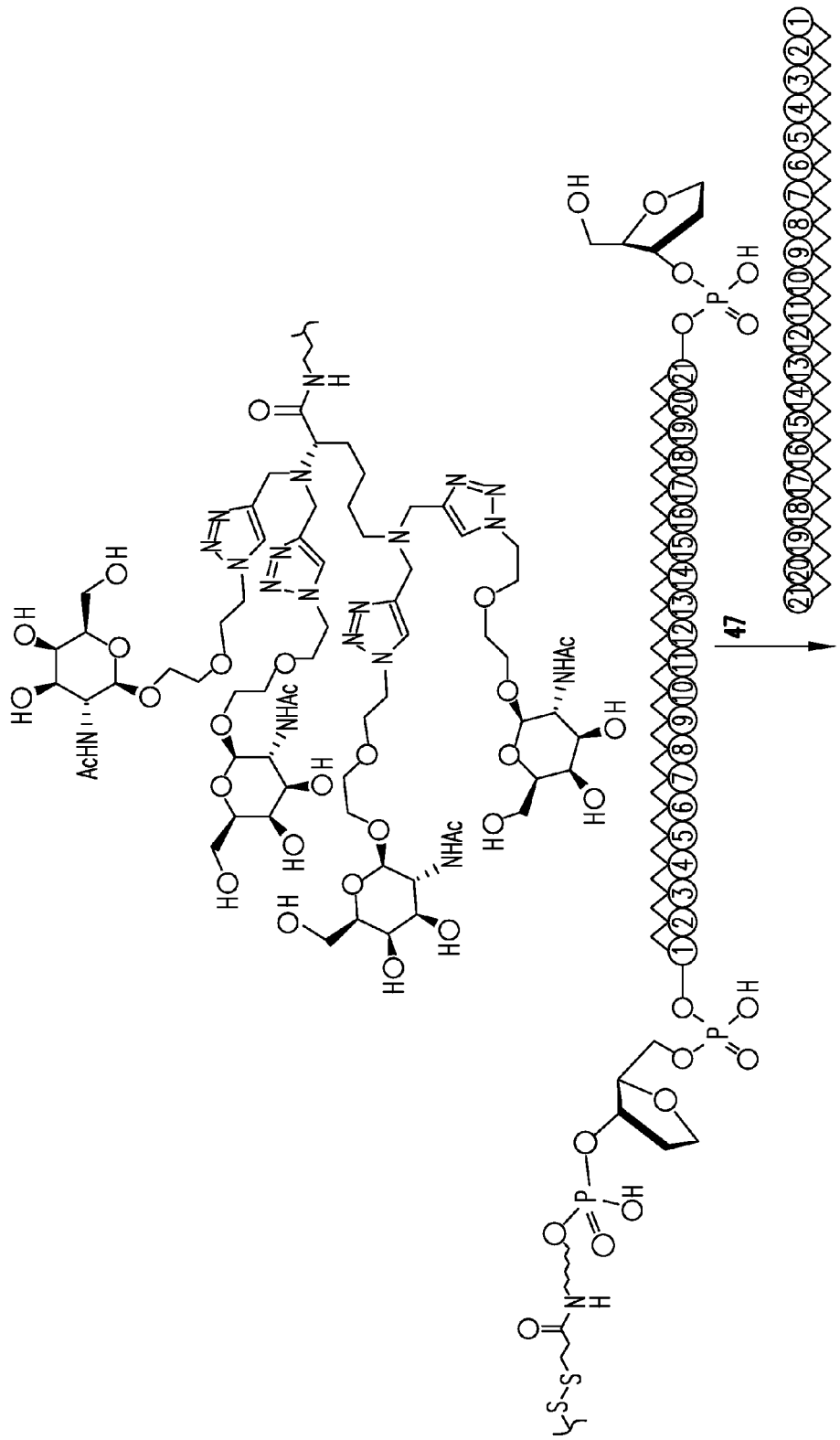
Figure 38E:
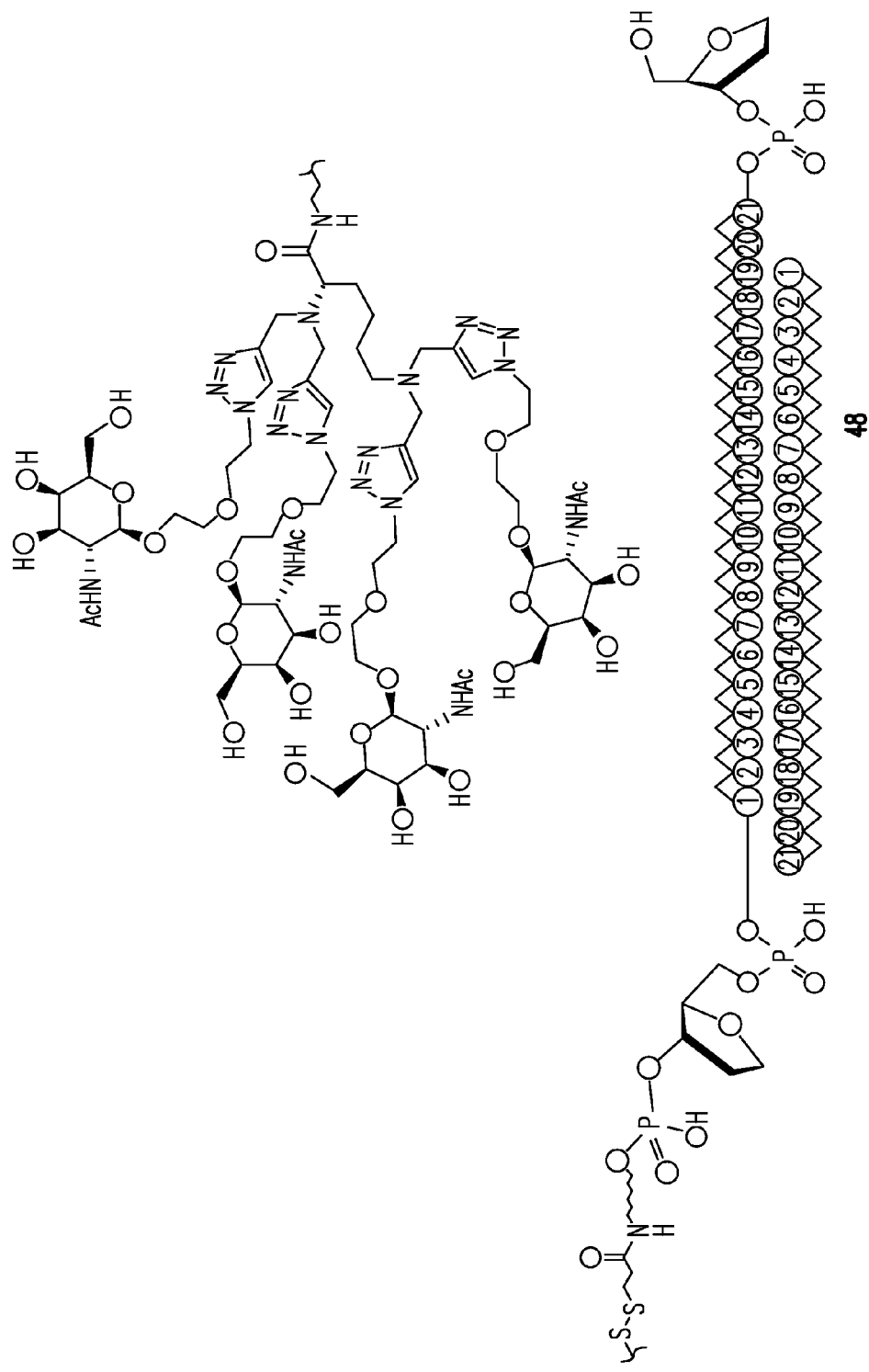

FIG. 37. Scheme 40 as shown in FIG. 37 showing examples of different linkers from Table 2, for conjugating tetraGalNAc to siRNA.

FIG. 38. Scheme 41 as shown in FIG. 38A to FIG. 38E for preparing Compounds and/or Conjugates 46-48.

Figure 39A:
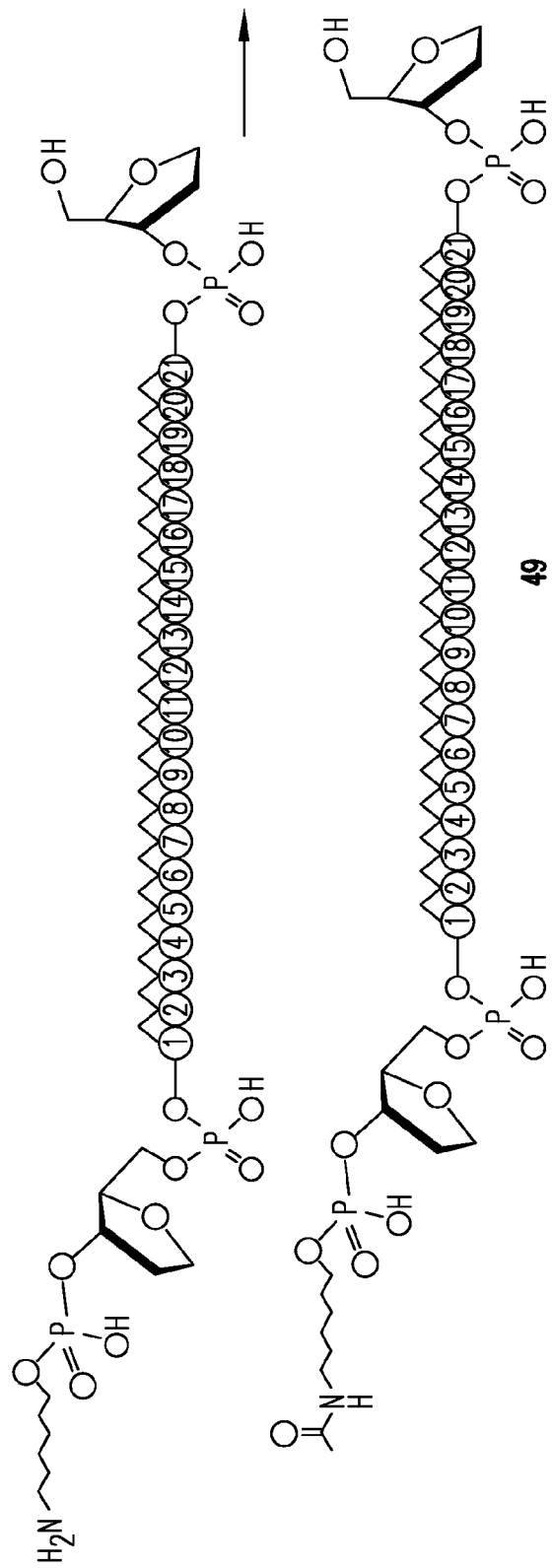
Figure 39B:
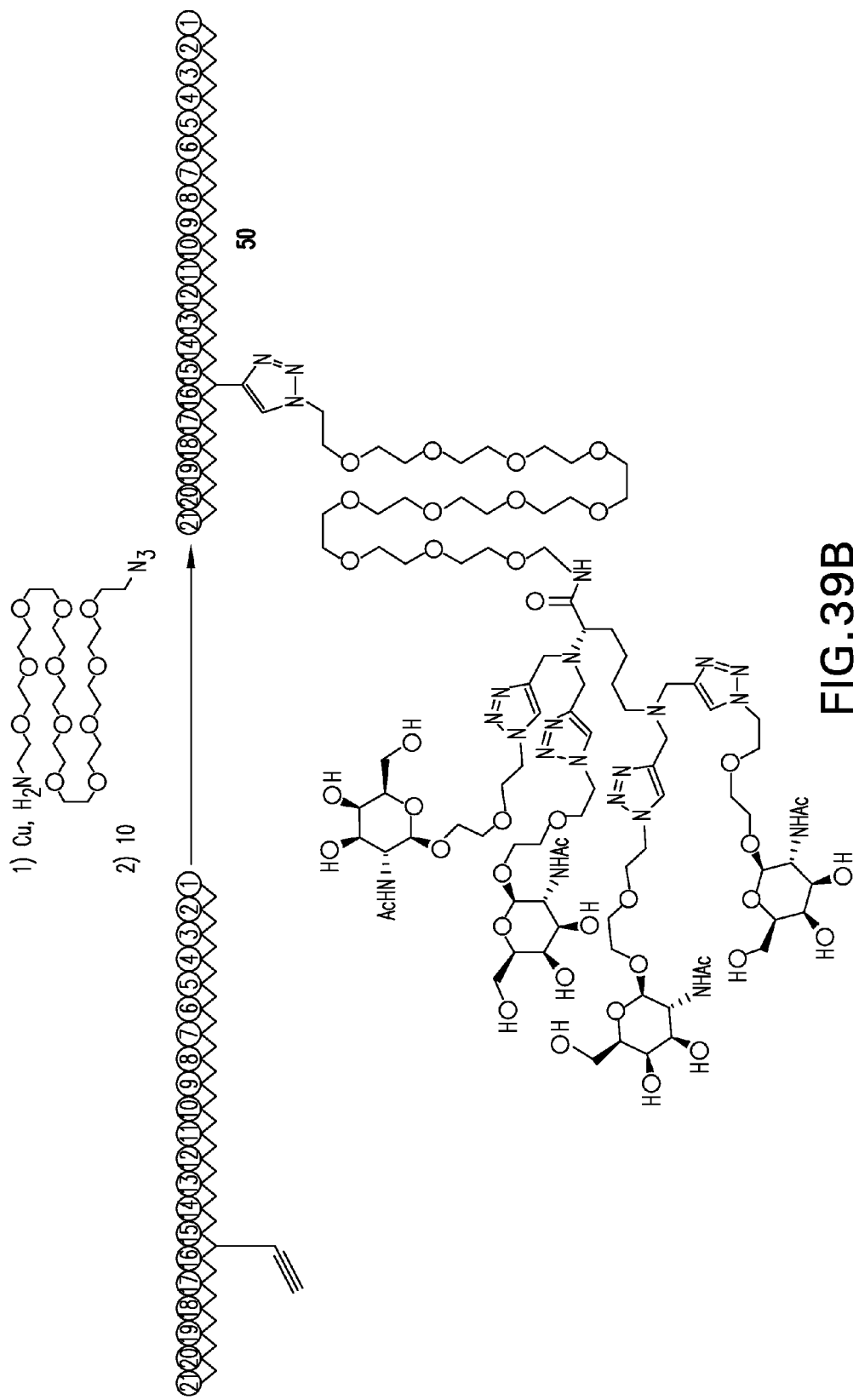
Figure 39C:
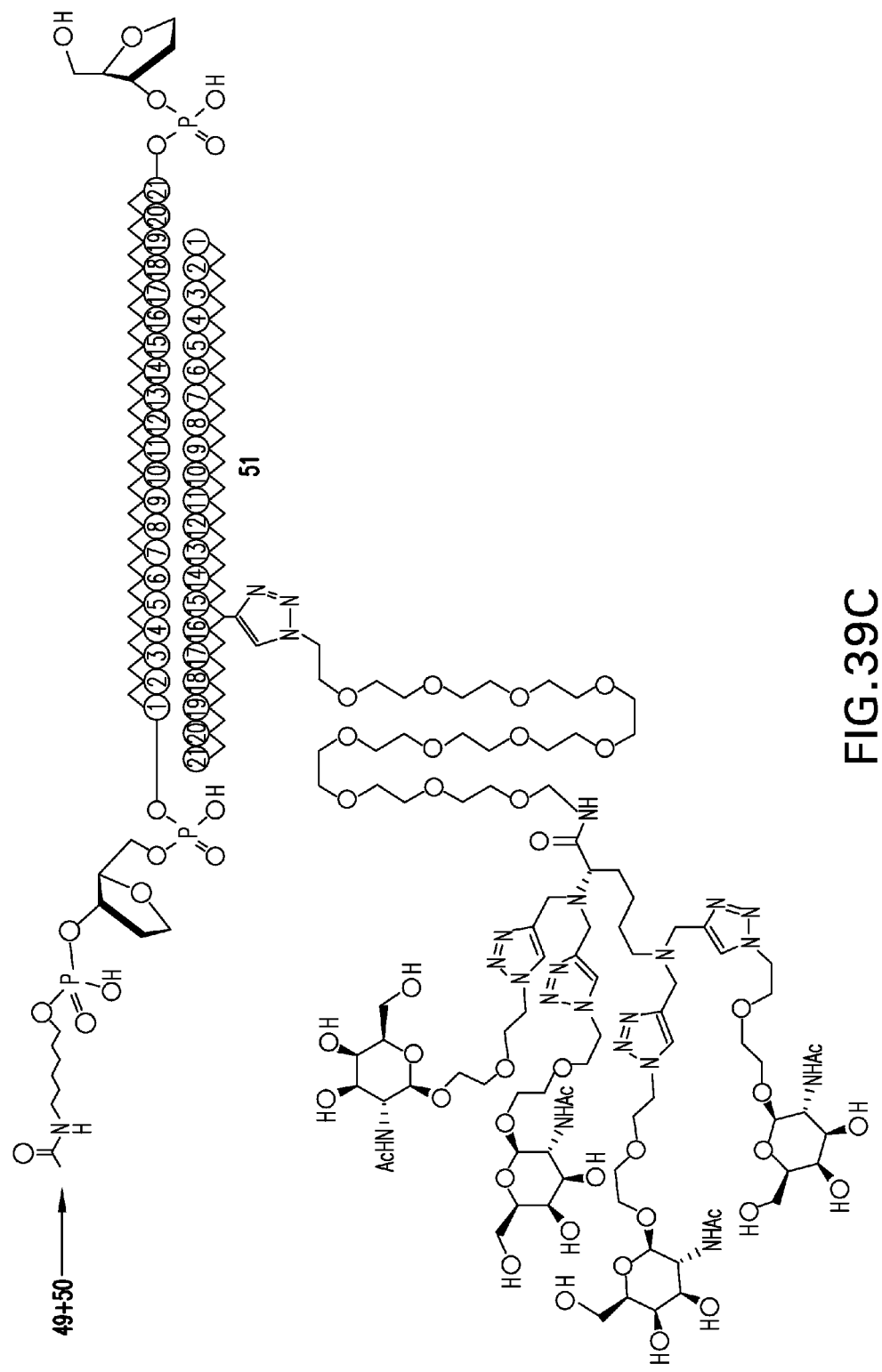

FIG. 39. Scheme 42 as shown in FIG. 39A to FIG. 39C for preparing Compounds and/or Conjugates 49-51.

Figure 40:
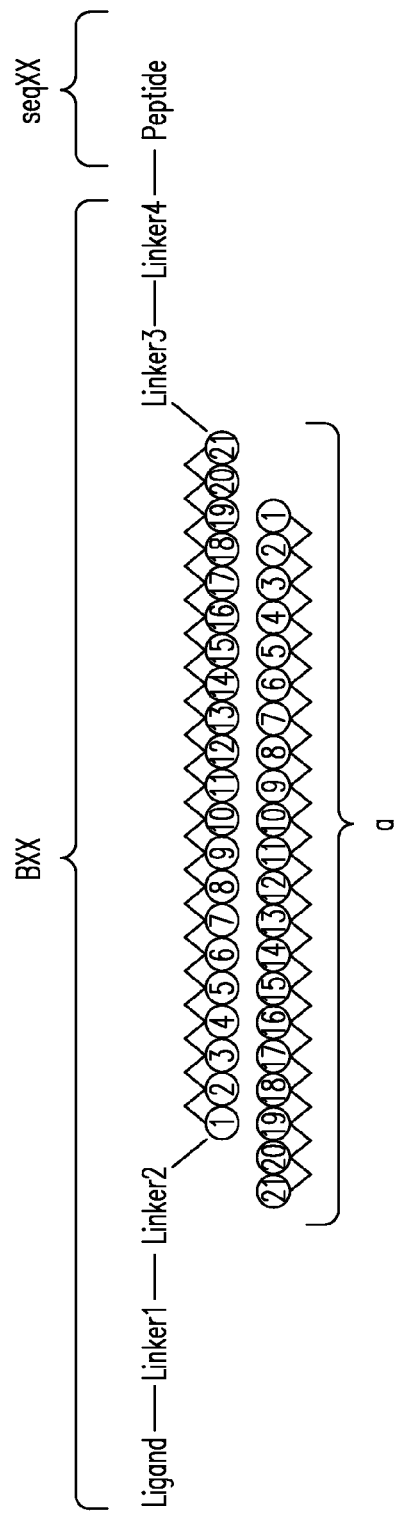

FIG. 40. Scheme 43 as shown in FIG. 40 showing a general description for illustrative purposes of nomenclature used in Table 6.

DETAILED DESCRIPTION OF THE INVENTION

Disclosed herein are single chemical conjugates comprising a single stranded or double stranded oligonucleotide; one or more tetraGalNAc ligands of Formula (I), (II) or (III), which may be the same or different;

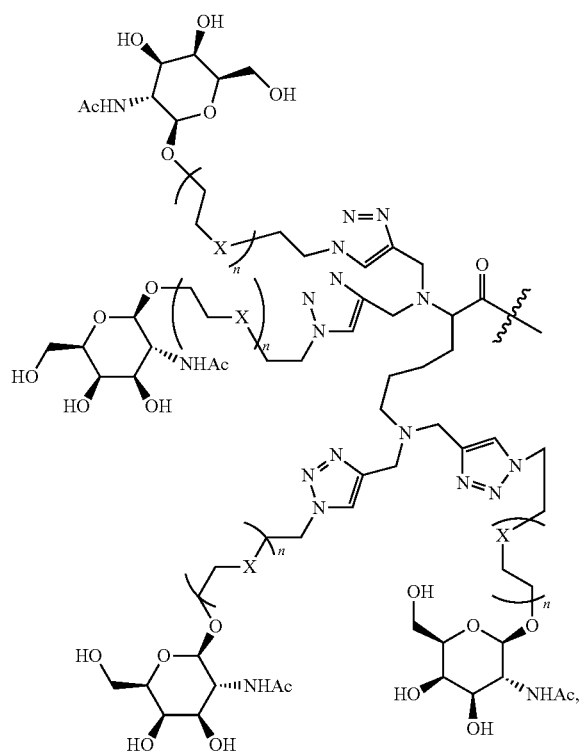

(I)

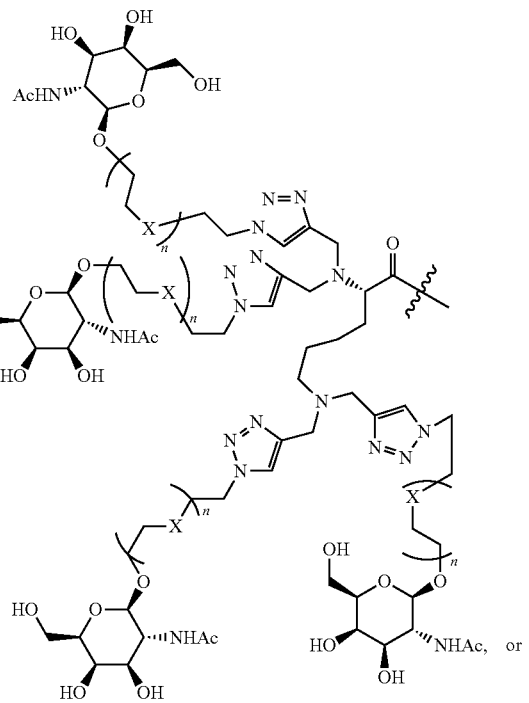

(II)

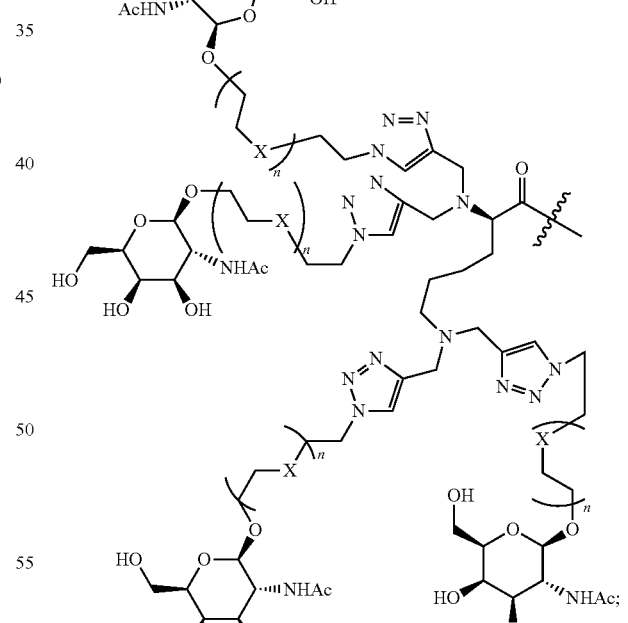

(III)

wherein X is —O—, —S—, —CR$^1$R$^2$— or —NR$^1$—, wherein R$^1$ and R$^2$ are each independently selected from the group consisting of hydrogen and C1-C6alkyl; n is 1, 2, 3, or 4; and the bond with "～～" indicates the point of attachment; and one or more peptides, which may be the same or different. Other functionalities, such as targeting ligands, solubilizing agents, pharmacokinetics enhancing agents, lipids, and/or masking agents are optionally present. In one embodiment, $R^1$ and $R^2$ are each independently selected from the group consisting of hydrogen, methyl and ethyl. In another embodiment, $R^1$ and $R^2$ are each hydrogen.

In one embodiment, the oligonucleotide is a short interfering RNA (siRNA). In another embodiment, the siRNA is a single stranded siRNA. In another embodiment, the siRNA is a double stranded siRNA.

The use of the tetraGalNAc disclosed herein provides effective delivery of the oligonuleotide or siRNA by directing the modular composition to a particular cell. For example, the targeting ligand may specifically or non-specifically bind with a molecule on the surface of a target cell and facilitate internalization of the ligand-siRNA conjugate.

The peptides may function as endosomolytic, cell penetrating and/or fusogenic agents. In addition, the peptide may have cationic, zwitterionic, neutral, anionic character. Incorporation of both the tetraGalNAc and the peptide in the modular composition may further improve the delivery efficiency of the oligonuleotide or siRNA.

A linker may be present between each peptide and the oligonucleotide or between each tetraGalNAc and the oligonucleotide. The linkers are attached to the oligonucleotide at different 2'-positions of the ribose rings and/or the terminal 3' and/or 5'-positions of the oligonucleotide.

In one embodiment, a modular composition comprises 1) a single stranded or double stranded oligonucleotide; 2) one or more tetraGalNAc ligands of Formula (I), (II) or (III), which may be the same or different, wherein X is —O—, —S—, —CH$_2$— or —NH—; n is 1, 2, 3, or 4; and the bond with "∼∼∼" indicates the point of attachment; optionally, 3) one or more linkers, which may be the same or different; 4) one or more peptides independently selected from Table 3, which may be the same or different; and optionally, 5) one or more targeting ligands, solubilizing agents, pharmacokinetics enhancing agents, lipids, and/or masking agents.

In another embodiment, a modular composition comprises 1) a single stranded or double stranded oligonucleotide; 2) 1-8 tetraGalNAc ligands of Formula (I), (II) or (III), which may be the same or different, wherein X is —O—, —S—, —CH$_2$— or —NH—; n is 1, 2, 3, or 4; 3) 1-24 linkers, which may be the same or different; 4) 1-8 peptides independently selected from Table 3, which may be the same or different; and optionally, 5) 1-8 targeting ligands, solubilizing agents, pharmacokinetics enhancing agents, lipids, and/or masking agents.

In another embodiment, a modular composition comprises 1) a single stranded or double stranded siRNA; 2) 1-8 tetraGalNAc ligands of Formula (I), (II) or (III), which may be the same or different, wherein X is —O—, —S—, —CH$_2$— or —NH—; n is 1, 2, 3, or 4; 3) 1-24 linkers, which may be the same or different; 4) 1-8 peptides independently selected from Table 3, which may be the same or different; and optionally, 5) 1-8 targeting ligands, solubilizing agents, pharmacokinetics enhancing agents, lipids, and/or masking agents.

In one subset of the above embodiments, the tetraGalNAc ligands and/or the peptides are attached to the oligonucleotide or siRNA at different 2'-positions of the ribose rings and/or at different terminal 3' and/or 5'-positions of the oligonucleotide or siRNA.

In another subset of the above embodiments, the tetraGalNAc ligands and/or the peptides are attached to the oligonucleotide or siRNA optionally via linkers. In one embodiment, the linkers are present.

In another subset of the above embodiments, the tetraGalNAc ligands and/or the peptides are attached to the oligonucleotide or siRNA at different 2'-positions of the ribose rings and/or at different terminal 3' and/or 5'-positions of the oligonucleotide or siRNA; and the tetraGalNAc ligands and/or the peptides are attached to the oligonucleotide or siRNA via linkers.

In another subset of the above embodiments, the tetraGalNAc ligands are attached to the oligonucleotide or siRNA via linkers and the linkers are attached to the oligonucleotide or siRNA at different 2'-positions of the ribose rings.

In another subset of the above embodiments, the tetraGalNAc ligands are attached to the oligonucleotide or siRNA via linkers and the linkers are attached to the oligonucleotide or siRNA at different terminal 3' and/or 5'-positions of the oligonucleotide.

In another subset of the above embodiments, X is —O—, —S—, or —CH$_2$—. In another embodiment, X is —O— or —CH$_2$—. In another embodiment, n is 1, 2 or 3. In another embodiment, X is —O— and n is 1 or 2. In another embodiment, X is —CH$_2$— and n is 1 or 2. In another embodiment, X is —O— and n is 1. In yet another embodiment, X is —CH$_2$— and n is 1.

In another subset of the above embodiments, the oligonucleotide or siRNA is single stranded. In another embodiment, the oligonucleotide or siRNA is double stranded.

In another subset of the above embodiments, the composition comprises 1-6 tetraGalNAc ligands. In another embodiment, the composition comprises 1-4 tetraGalNAc ligands. In another embodiment, the composition comprises 1-2 tetraGalNAc ligands. In yet another embodiment, the composition comprises 1 tetraGalNAc ligand.

In another subset of the above embodiments, the composition comprises 1-6 peptides. In another embodiment, the composition comprises 1-4 peptides. In another embodiment, the composition comprises 1-2 peptides. In yet another embodiment, the composition comprises 1 peptide.

In another subset of the above embodiments, the oligonucleotide or siRNA is double stranded and the tetraGalNAc ligands are attached to the guide strand at different 2'-positions of the ribose rings.

In another subset of the above embodiments, the oligonucleotide or siRNA is double stranded the tetraGalNAc ligands are attached to the guide strand at different terminal 3' and/or 5'-positions.

In another subset of the above embodiments, the oligonucleotide or siRNA is double stranded and the tetraGalNAc ligands are attached to the passenger strand at different 2'-positions of the ribose rings.

In another subset of the above embodiments, the oligonucleotide or siRNA is double stranded and the tetraGalNAc ligands are attached to the passenger strand at different terminal 3' and/or 5'-positions.

In another subset of the above embodiments, the oligonucleotide or siRNA is double stranded and the tetraGalNAc ligands are attached to both the guide strand and the passenger strand at different 2'-positions of the ribose rings and/or different terminal 3' and/or 5'-positions.

In another subset of the above embodiments, the oligonucleotide or siRNA is double stranded and the peptides are attached to the guide strand at different 2'-positions of the ribose rings.

In another subset of the above embodiments, the oligonucleotide or siRNA is double stranded and the peptides are attached to the guide strand at different terminal 3' and/or 5'-positions.

In another subset of the above embodiments, the oligonucleotide or siRNA is double stranded and the peptides are attached to the passenger strand at different 2'-positions of the ribose rings.

In another subset of the above embodiments, the oligonucleotide or siRNA is double stranded and the peptides are attached to the passenger strand at different terminal 3' and/or 5'-positions.

In another subset of the above embodiments, the oligonucleotide or siRNA is double stranded and the peptides are attached to both the guide strand and the passenger strand at different 2'-positions of the ribose rings and/or different terminal 3' and/or 5'-positions.

In another subset of the above embodiments, the oligonucleotide or siRNA is double stranded and the tetraGalNAc ligands and the peptides are attached to the same or different strands via linkers. In one embodiment, each linker is independently selected Table 1. In another embodiment, each linker is independently selected Table 2.

In another subset of the above embodiments, the oligonucleotide or siRNA is double stranded and the tetraGalNAc ligands and the peptides are attached to the same strand.

In another subset of the above embodiments, the oligonucleotide or siRNA is double stranded and the tetraGalNAc ligands and the peptides are attached to different strands.

In another subset of the above embodiments, the oligonucleotide or siRNA is double stranded and the optional targeting ligands, solubilizing agents, pharmacokinetics enhancing agents, lipids, and/or masking agents are attached to the same or different strands.

In another subset of the above embodiments, the oligonucleotide or siRNA is double stranded and the optional targeting ligands, solubilizing agents, pharmacokinetics enhancing agents, lipids, and/or masking agents are attached to the same or different strands via linkers. In one embodiment, each linker is independently selected from Table 1. In another embodiment, each linker is independently selected from Table 2.

In one embodiment, a modular composition comprises 1) a single stranded or double stranded siRNA; 2) 1-8 tetraGalNAc ligands of Formula (I), (II) or (III), which may be the same or different; wherein X is —O—, —S—, —CH$_2$— or —NH—; and n is 1, 2, 3, or 4; 3) 1-24 linkers, which may be the same or different; 4) 1-8 peptides independently selected from Table 3, which may be the same or different; and optionally, 5) 1-8 targeting ligands, solubilizing agents, pharmacokinetics enhancing agents, lipids, and/or masking agents; wherein the tetraGalNAc ligands and/or the peptides are attached to the siRNA at different 2'-positions of the ribose rings and/or at different terminal 3' and/or 5'-positions of the siRNA; and wherein the tetraGalNAc ligands and/or the peptides are attached to the siRNA optionally via linkers. In one embodiment, the linkers are present. In another embodiment, X is —O—, —S—, or —CH$_2$—, and n is 1, 2 or 3. In another embodiment, X is —O— or —CH$_2$—, and n is 1 or 2.

In another embodiment, a modular composition comprises 1) a double stranded siRNA; 2) 1-6 tetraGalNAc ligands of Formula (I), (II) or (III), which may be the same or different; wherein X is —O—, —S—, or —CH$_2$—; and n is 1 or 2 or 3; 3) 1-18 linkers, which may be the same or different; 4) 1-6 peptides independently selected from Table 3, which may be the same or different; and optionally, 5) 1-6 targeting ligands, solubilizing agents, pharmacokinetics enhancing agents, lipids, and/or masking agents; wherein the tetraGalNAc ligands and/or the peptides are attached to the siRNA at different 2'-positions of the ribose rings and/or at different terminal 3' and/or 5'-positions of the siRNA; and wherein the tetraGalNAc ligands and/or the peptides are attached to the siRNA optionally via linkers. In one embodiment, the linkers are present. In another embodiment, X is —O—, —S—, or —CH$_2$— and n is 1 or 2. In another embodiment, the linkers are independently selected from Table 1. In another embodiment, the linkers are independently selected from Table 2. In another embodiment, the peptides of 4) are independently selected from Table 4.

In another embodiment, a modular composition comprises 1) a double stranded siRNA; 2) 1-4 tetraGalNAc ligands of Formula (I), (II) or (III), which may be the same or different; wherein X is —O—, —S—, or —CH$_2$—; and n is 1 or 2; 3) 1-12 linkers, which may be the same or different; 4) 1-4 peptides independently selected from Table 3, which may be the same or different; and optionally, 5) 1-4 targeting ligands, solubilizing agents, pharmacokinetics enhancing agents, lipids, and/or masking agents; wherein the tetraGalNAc ligands and/or the peptides are attached to the siRNA at different 2'-positions of the ribose rings and/or at different terminal 3' and/or 5'-positions of the siRNA; and wherein the tetraGalNAc ligands and/or the peptides are attached to the siRNA via linkers. In one embodiment, X is —O— or —CH$_2$— and n is 1 or 2. In another embodiment, the linkers are independently selected from Table 1. In another embodiment, the linkers are independently selected from Table 2. In another embodiment, the peptides are independently selected from Table 4.

In another embodiment, a modular composition comprises 1) a double stranded siRNA; 2) 1-4 tetraGalNAc ligands of Formula (IV), (V) or (VI), which may be the same or different:

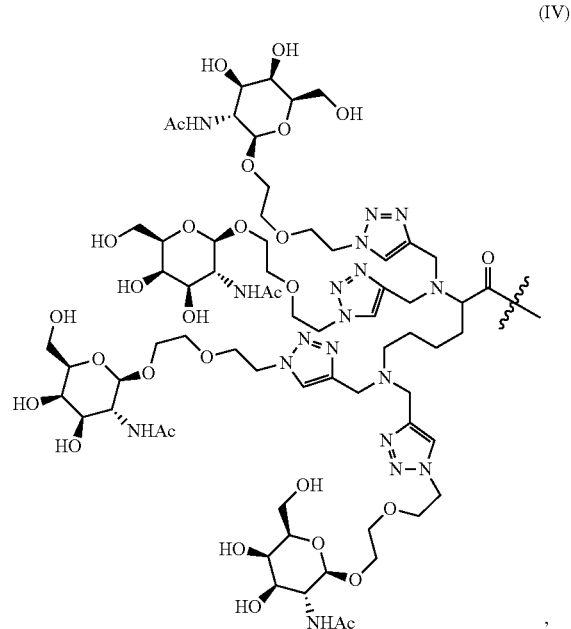 [SMILES: *C(=O)[C@@H](CCCCN(Cc1cn(CCOCCO[C@@H]2O[C@H](CO)[C@H](O)[C@H](O)[C@H]2NC(C)=O)nn1)Cc1cn(CCOCCO[C@@H]2O[C@H](CO)[C@H](O)[C@H](O)[C@H]2NC(C)=O)nn1)N(Cc1cn(CCOCCO[C@@H]2O[C@H](CO)[C@H](O)[C@H](O)[C@H]2NC(C)=O)nn1)Cc1cn(CCOCCO[C@@H]2O[C@H](CO)[C@H](O)[C@H](O)[C@H]2NC(C)=O)nn1]

(IV)

-continued

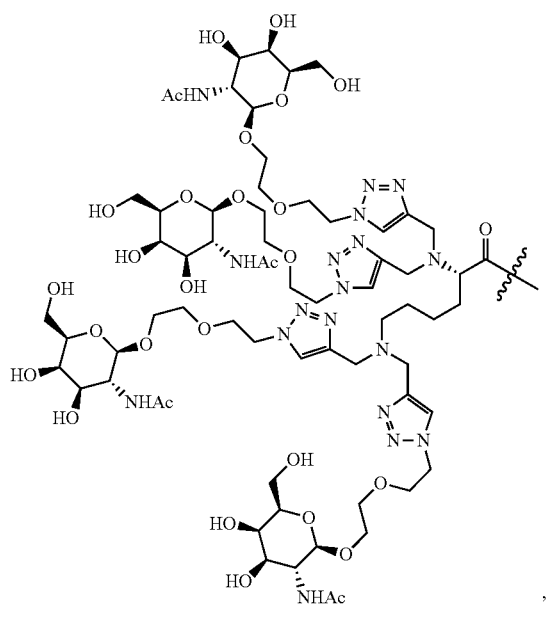

(V)

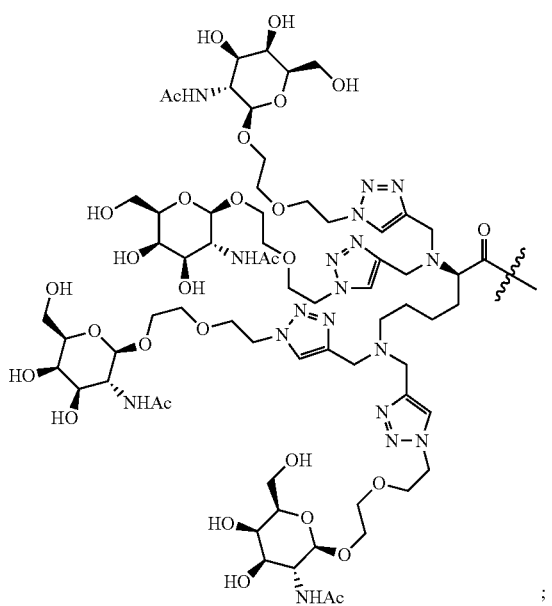

, or (VI)

3) 1-12 linkers independently selected from Table 1, which may be the same or different; 4) 1-4 peptides independently selected from Table 3, which may be the same or different; and optionally, 5) 1-4 targeting ligands, solubilizing agents, pharmacokinetics enhancing agents, lipids, and/or masking agents; wherein the tetraGalNAc ligands and/or the peptides are attached to the siRNA at different 2'-positions of the ribose rings and/or at different terminal 3' and/or 5'-positions of the siRNA; and wherein the tetraGalNAc ligands and/or the peptides are attached to the siRNA via linkers.

In another embodiment, a modular composition comprises 1) a double stranded siRNA; 2) 1-4 tetraGalNAc ligands of Formula (IV), (V) or (VI); 3) 1-12 linkers independently selected from Table 2, which may be the same or different; 4) 1-4 peptides independently selected from Table 4, which may be the same or different; and optionally, 5) 1-4 targeting ligands, solubilizing agents, pharmacokinetics enhancing agents, lipids, and/or masking agents; wherein the tetraGalNAc ligands and/or the peptides are attached to the siRNA at different 2'-positions of the ribose rings and/or at different terminal 3' and/or 5'-positions of the siRNA; and wherein the tetraGalNAc ligands and/or the peptides are attached to the siRNA via linkers.

In one subset of the above embodiments, the tetraGalNAc ligands and/or the peptides are attached to the siRNA via linkers; and wherein the tetraGalNAc ligands and/or the peptides are attached to the same strand.

In another subset of the above embodiments, the tetraGalNAc ligands and/or the peptides are attached to the siRNA via linkers; and wherein the tetraGalNAc ligands and the peptides are attached to different strands.

To illustrate the invention via cartoon, the invention features a modular composition, comprising an oligonucleotide ($[O_1][O_2][O_3] \ldots [O_n]$), one or more tetraGalNAc(s) ligands (G), one or more linker(s) (L), one or more peptide (s) (P), and one or more optional lipid(s) (X), one or more targeting ligand(s) (X), and/or one or more solubilizing group(s) (X).

In an embodiment, the modular composition may have the formula:

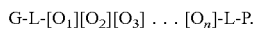

$$G\text{-}L\text{-}[O_1][O_2][O_3] \ldots [O_n]\text{-}L\text{-}P.$$

In another embodiment, the modular composition may have the formula:

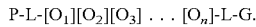

$$P\text{-}L\text{-}[O_1][O_2][O_3] \ldots [O_n]\text{-}L\text{-}G.$$

Non-limiting examples of modular compositions comprising double stranded oligonucleotides with terminal conjugations are shown in FIG. 1.

Non-limiting examples of modular compositions comprising double stranded oligonucleotides with terminal conjugations are shown in FIG. 2.

Figure 3A:
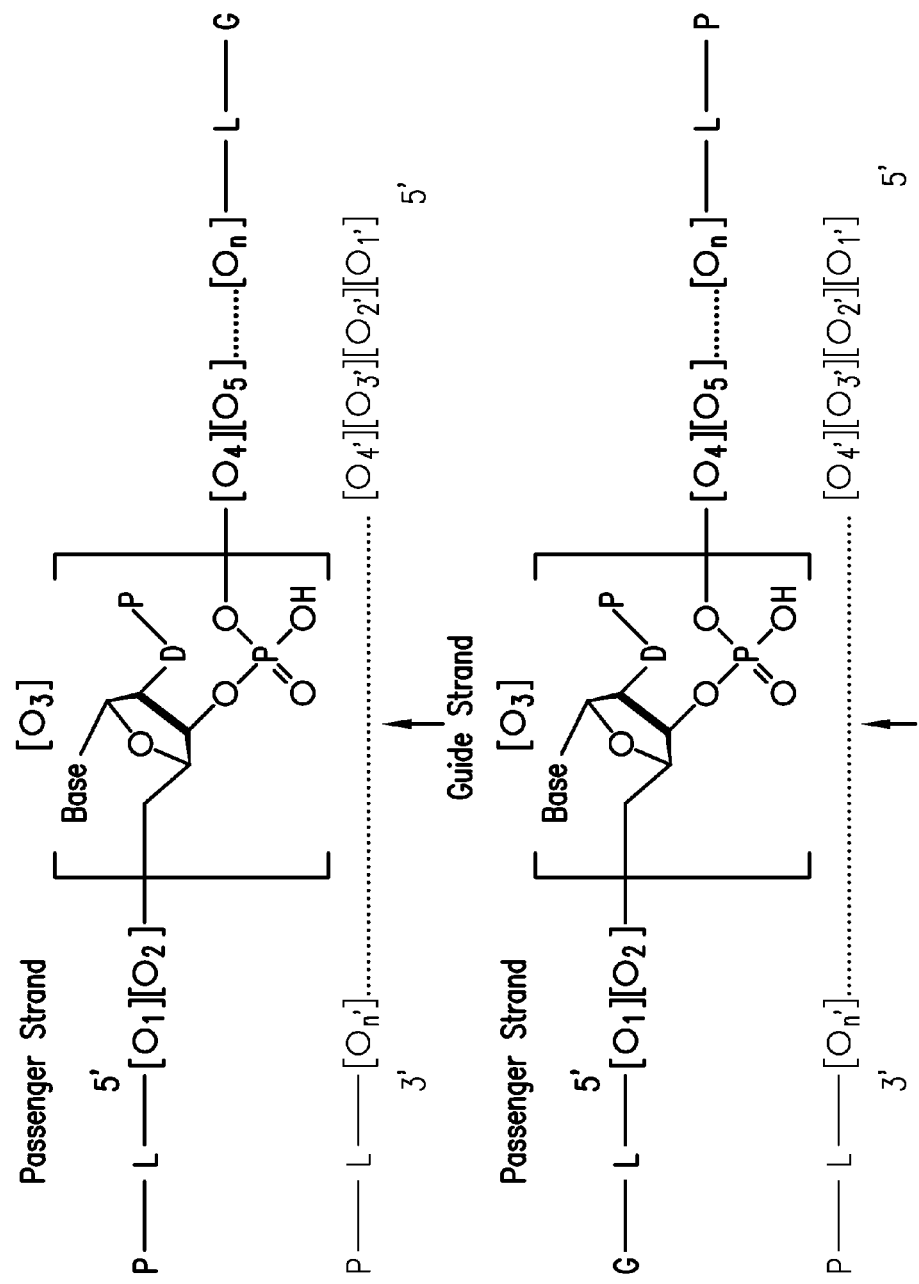
FIG. 3A-3B. Non-limiting examples of modular compositions comprising double stranded oligonucleotides with internal and/or terminal conjugations are shown in FIG. 3A and FIG. 3B.
Figure 3B:
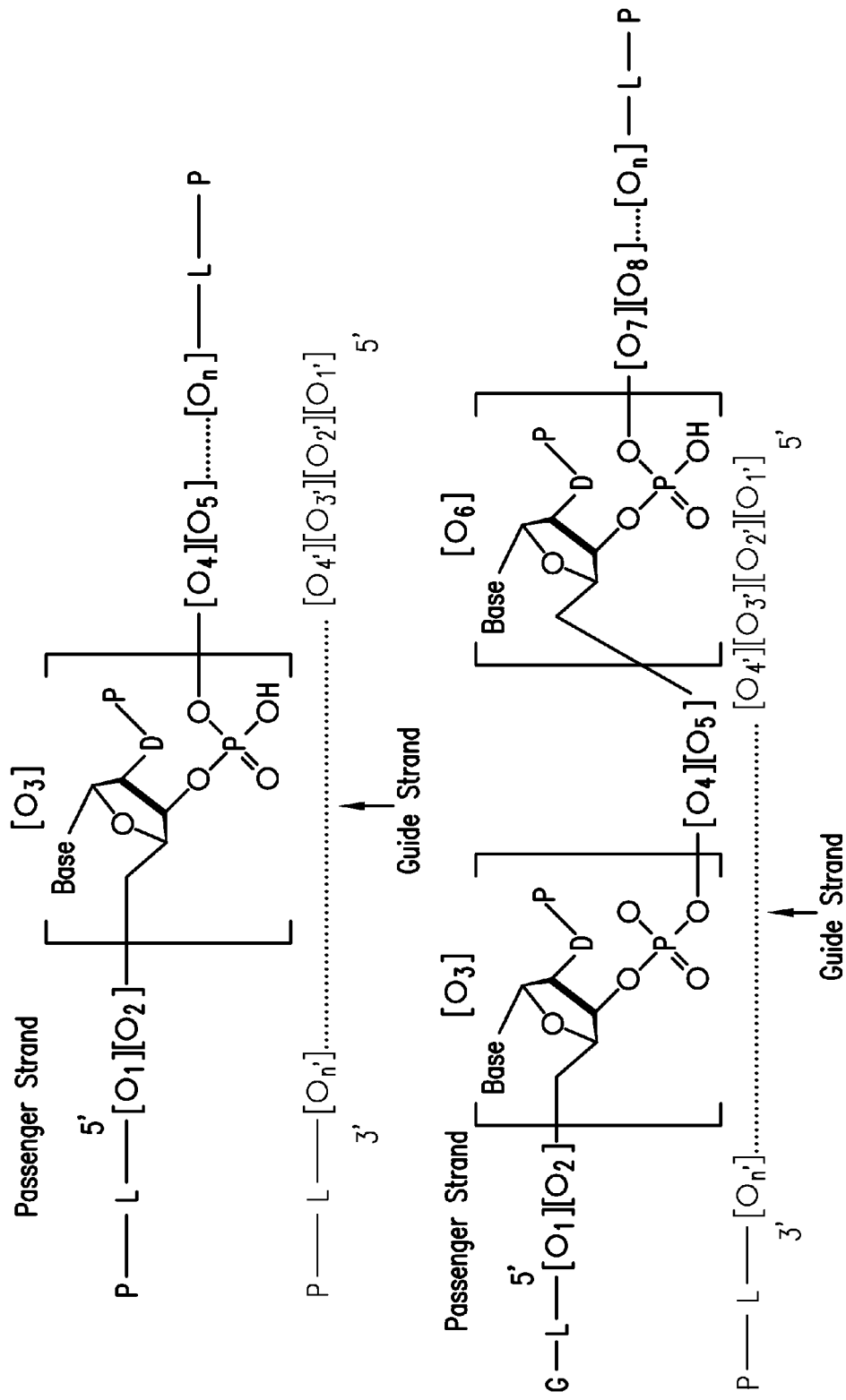

Non-limiting examples of modular compositions comprising double stranded oligonucleotides with internal and/or terminal conjugations are shown in FIG. 3A and FIG. 3B.

These examples are used as illustration only. One skilled in the art will recognize that a variety of permutations for placing the desired components on the passenger and guide strand exist.

Any number of linkers, and therefore any number of peptides, can be attached to the oligonucleotide. The range of numbers of linkers is from 1-16. A more preferred range of numbers of linkers is from 1-12, or more specifically, 1-8, or even more specifically, 1-4.

The range of numbers of tetraGalNAc ligands is from 1-8. A more preferred range of numbers of tetraGalNAc ligands is from 1-6, or more specifically, 1-4, or even more specifically, 1-2.

The range of numbers of peptides is from 1-8. A more preferred range of numbers of peptides is from 1-6, or more specifically, 1-4, or even more specifically, 1-2.

The two strands contain n and n' nucleotides respectively. The numbers n and n' can be equal or different. The numbers are integers ranging from 8 to 50. Preferably, the numbers are integers ranging from 12-28. More preferably, the numbers are integers ranging from 19-21.

Figure 4:
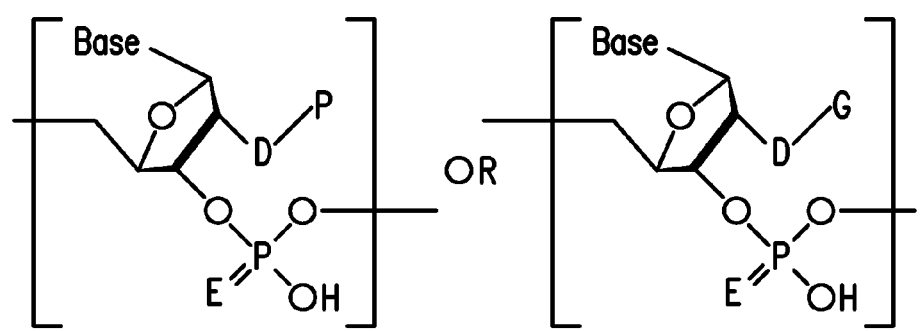
FIG. 4. Generic structures of each nucleotide [$O_n$] or [$O_{n'}$] that contain a linker (L-P and/or L-G).

As an example, each nucleotide $[O_n]$ or $[O_{n'}]$, that contains a linker (L-P and/or L-G) has generic structures as shown in FIG. 4.

For each nucleotide, 1) E=oxygen (O) or sulfur (S); 2) Base=A, U, G or C, which can be modified or unmodified; 3) D is the connection point between ribose ring and linker L, D=oxygen (O), sulfur (S, S(O) or S(O)$_2$), nitrogen (N—R, wherein R=H, alkyl, L-P or L-X), carbon (CH—R, wherein R=H, alkyl, L-P, or L-X), or phosphorus (P(O)R or P(O)(OR), wherein R=alkyl, L-P, or L-X). Preferably, D=oxygen (O).

The two nucleotides $[O_{n-1}]$ and $[O_n]$ or $[O_{n'-1}]$ and $[O_{n'}]$ are connected via phosphodiester or thio-phosphodiester bonds.

When the oligonucleotide is a double-stranded oligonucleotide, the "G-L", "P-L" and the lipid, targeting ligand, and/or solubilizing group may be located on the same strand or on different strands.

In some embodiments, the "G-L" and "P-L" are on the same strand.

In some embodiments, the "G-L" and "P-L" are on the passenger strand.

In some embodiments, the "G-L" and "P-L" are on the guide strand.

In some embodiments, the "G-L" and "P-L" are located on different strands.

In some embodiments, the "G-L" is on the passenger strand while the "P-L" is on the guide strand.

In some embodiments, the "G-L" and "P-L" are on different strands but on the same terminal end of the double-stranded oligonucleotide.

In some embodiments, the "G-L" and "P-L" are on different strands and on the opposite terminal ends of the double-stranded oligonucleotide.

In some embodiments, the "G-L" can be located on multiple terminal ends of either the passenger or guide strand and "P-L" can be located on the remaining terminal ends of the passenger and guide strands.

In some embodiments, one "G-L" and two or more "P-L" are present in the oligonucleotide.

In some embodiments, two or more "G-L" and two or more "P-L" are present in the oligonucleotide.

In some embodiments, when the oligonucleotide is a double-stranded oligonucleotide and multiple "G-L" and/or "P-L" are present, such multiple "G-L" components and/or "P-L" may all be present in one strand or both strands of the double stranded oligonucleotide.

When multiple "G-L" components and/or "P-L" are present, they may all be the same or different.

In some embodiments, the "G-L" and/or "P-L" are on internal nucleotides only (i.e. excluding the 3'- and 5'-terminal ends of the oligonucleotide).

In another aspect, the invention includes a method of delivering an oligonucleotide or siRNA to a cell. The method includes (a) providing or obtaining a modular composition disclosed herein; (b) contacting a cell with the modular composition; and (c) allowing the cell to internalize the modular composition.

The method can be performed in vitro, ex vivo or in vivo, e.g., to treat a subject identified as being in need of an oligonucleotide or siRNA. A subject in need of said oligonucleotide is a subject, e.g., a human, in need of having the expression of a gene or genes, e.g., a gene related to a disorder, downregulated or silenced.

In one aspect, the invention provides a method for inhibiting the expression of one or more genes. The method comprising contacting one or more cells with an effective amount of an oligonucleotide of the invention, wherein the effective amount is an amount that suppresses the expression of the one or more genes. The method can be performed in vitro, ex vivo or in vivo.

The methods and compositions of the invention, e.g., the modular composition described herein, can be used with any oligonucleotides or siRNAs known in the art. In addition, the methods and compositions of the invention can be used for the treatment of any disease or disorder known in the art, and for the treatment of any subject, e.g., any animal, any mammal, such as any human. One of ordinary skill in the art will also recognize that the methods and compositions of the invention may be used for the treatment of any disease that would benefit from downregulating or silencing a gene or genes.

The methods and compositions of the invention, e.g., the modular composition described herein, may be used with any dosage and/or formulation described herein, or any dosage or formulation known in the art. In addition to the routes of administration described herein, a person skilled in the art will also appreciate that other routes of administration may be used to administer the modular composition of the invention.

Oligonucleotide

An "oligonucleotide" as used herein, is a double stranded or single stranded, unmodified or modified RNA or DNA. Examples of modified RNAs include those which have greater resistance to nuclease degradation than do unmodified RNAs. Further examples include those which have a 2' sugar modification, a base modification, a modification in a single strand overhang, for example a 3' single strand overhang, or, particularly if single stranded, a 5' modification which includes one or more phosphate groups or one or more analogs of a phosphate group. Examples and a further description of oligonucleotides can be found in WO2009/126933, which is hereby incorporated by reference.

In an embodiment, an oligonucleotide is an antisense, miRNA, peptide nucleic acid (PNA), poly-morpholino (PMO) or siRNA. The preferred oligonucleotide is an siRNA. Another preferred oligonuleotide is the passenger strand of an siRNA. Another preferred oligonucleotide is the guide strand of an siRNA.

siRNA siRNA directs the sequence-specific silencing of mRNA through a process known as RNA interference (RNAi). The process occurs in a wide variety of organisms, including mammals and other vertebrates. Methods for preparing and administering siRNA and their use for specifically inactivating gene function are known. siRNA includes modified and unmodified siRNA. Examples and a further description of siRNA can be found in WO2009/126933, which is hereby incorporated by reference.

A number of exemplary routes of delivery are known that can be used to administer siRNA to a subject. In addition, the siRNA can be formulated according to any exemplary method known in the art. Examples and a further description of siRNA formulation and administration can be found in WO2009/126933, which is hereby incorporated by reference.

The phrases "short interfering nucleic acid", "siNA", "short interfering RNA", "siRNA", "short interfering nucleic acid molecule", "oligonucleotide", "short interfering oligonucleotide molecule", or "chemically modified short interfering nucleic acid molecule" refer to any nucleic acid molecule capable of inhibiting or down regulating gene expression or viral replication by mediating RNA interference ("RNAi") or gene silencing in a sequence-specific manner. These terms can refer to both individual nucleic acid molecules, a plurality of such nucleic acid molecules, or pools of such nucleic acid molecules. The siNA can be a double-stranded nucleic acid molecule comprising self-complementary sense and antisense strands, wherein the antisense strand comprises a nucleotide sequence that is complementary to a nucleotide sequence in a target nucleic acid molecule or a portion thereof and the sense strand comprises a nucleotide sequence corresponding to the target nucleic acid sequence or a portion thereof. The siNA can be a polynucleotide with a duplex, asymmetric duplex, hairpin or asymmetric hairpin secondary structure, having self-complementary sense and antisense regions, wherein the antisense region comprises a nucleotide sequence that is complementary to a nucleotide sequence in a separate target nucleic acid molecule or a portion thereof and the sense region comprises a nucleotide sequence corresponding to the target nucleic acid sequence or a portion thereof. The siNA can be a circular single-stranded polynucleotide having two or more loop structures and a stem comprising self-complementary sense and antisense regions, wherein the antisense region comprises nucleotide sequence that is complementary to a nucleotide sequence in a target nucleic acid molecule or a portion thereof and the sense region comprises a nucleotide sequence corresponding to the target nucleic acid sequence or a portion thereof, and wherein the circular polynucleotide can be processed either in vivo or in vitro to generate an active siNA molecule capable of mediating RNAi. The siNA can also comprise a single-stranded polynucleotide having a nucleotide sequence complementary to nucleotide sequence in a target nucleic acid molecule or a portion thereof (for example, where such siNA molecule does not require the presence within the siNA molecule of a nucleotide sequence corresponding to the target nucleic acid sequence or a portion thereof), wherein the single-stranded polynucleotide can further comprise a terminal phosphate group, such as a 5'-phosphate (see for example, Martinez et al., 2002, *Cell*, 110, 563-574 and Schwarz et al., 2002, *Molecular Cell*, 10, 537-568), or 5',3'-diphosphate.

siRNA directs the sequence-specific silencing of mRNA through a process known as RNA interference (RNAi). The process occurs in a wide variety of organisms, including mammals and other vertebrates. Methods for preparing and administering siRNA and their use for specifically inactivating gene function are known. As used herein, siRNA includes chemically modified and unmodified nucleic acid molecules capable of inhibiting or down regulating gene expressions. Examples and a further description of siRNA can be found in WO2009/126933, which is hereby incorporated by reference.

A number of exemplary routes of delivery are known that can be used to administer siRNA to a subject. In addition, the siRNA can be formulated according to any exemplary method known in the art. Examples and a further description of siRNA formulation and administration can be found in WO2009/126933, which is hereby incorporated by reference.

Linkers

The covalent linkages between the tetraGalNAc and the oligonucleotide or siRNA of the modular composition and/or between the peptide and the oligonucleotide or siRNA may be mediated by a linker. This linker may be cleavable or non-cleavable, depending on the application. In certain embodiments, a cleavable linker may be used to release the oligonucleotide after transport from the endosome to the cytoplasm. The intended nature of the conjugation or coupling interaction, or the desired biological effect, will determine the choice of linker group. Linker groups may be combined or branched to provide more complex architectures. Suitable linkers include those as described in WO2009/126933, which is hereby incorporated by reference.

In one embodiment, the linkers of the instant invention are shown in Table 1:

TABLE 1

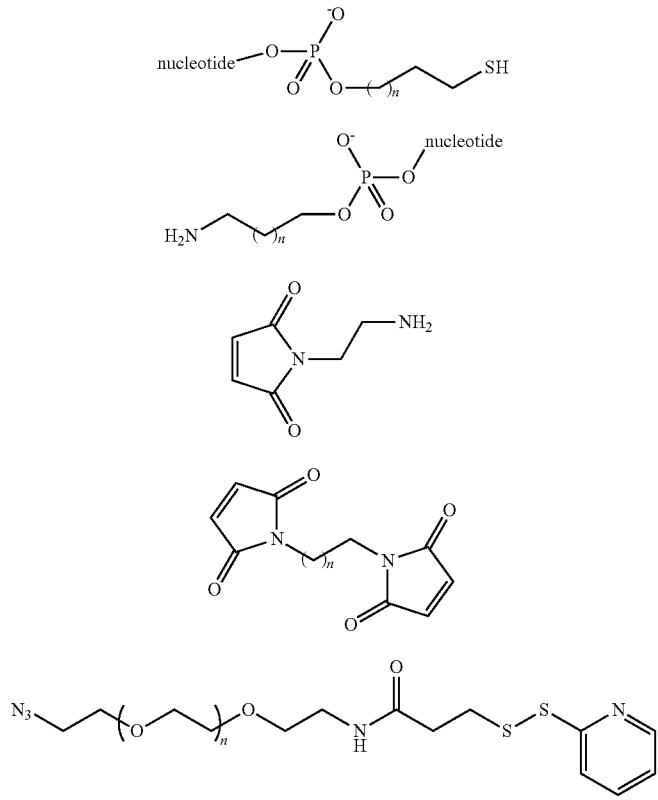

TABLE 1-continued
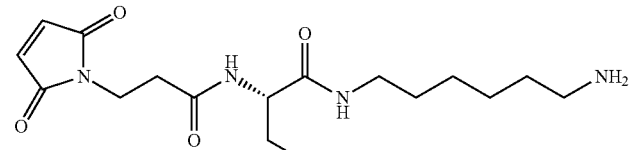
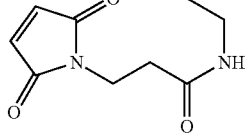
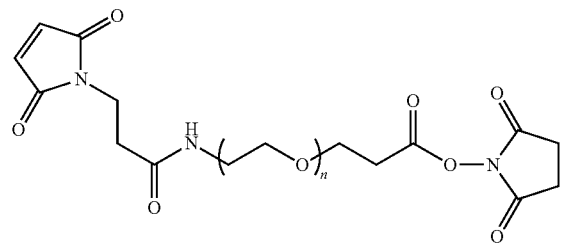
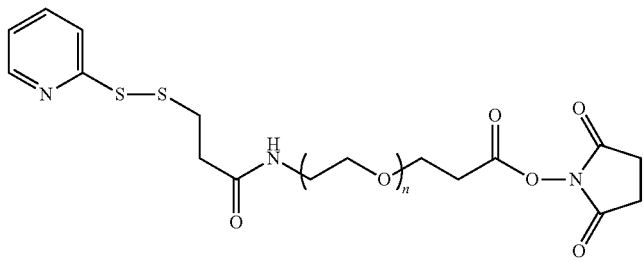
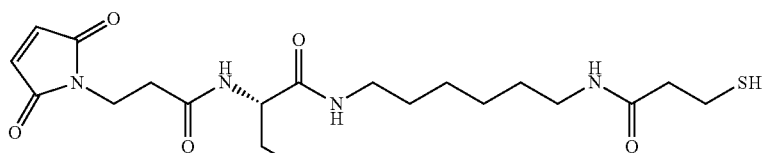
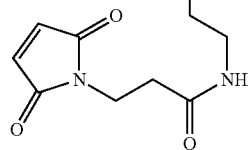
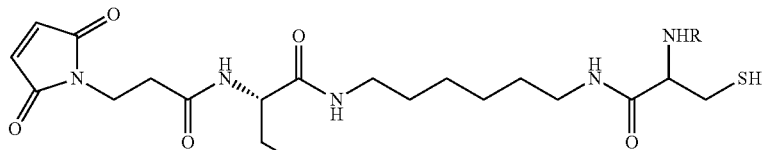
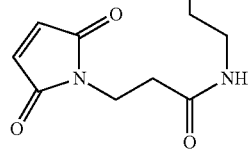

TABLE 1-continued

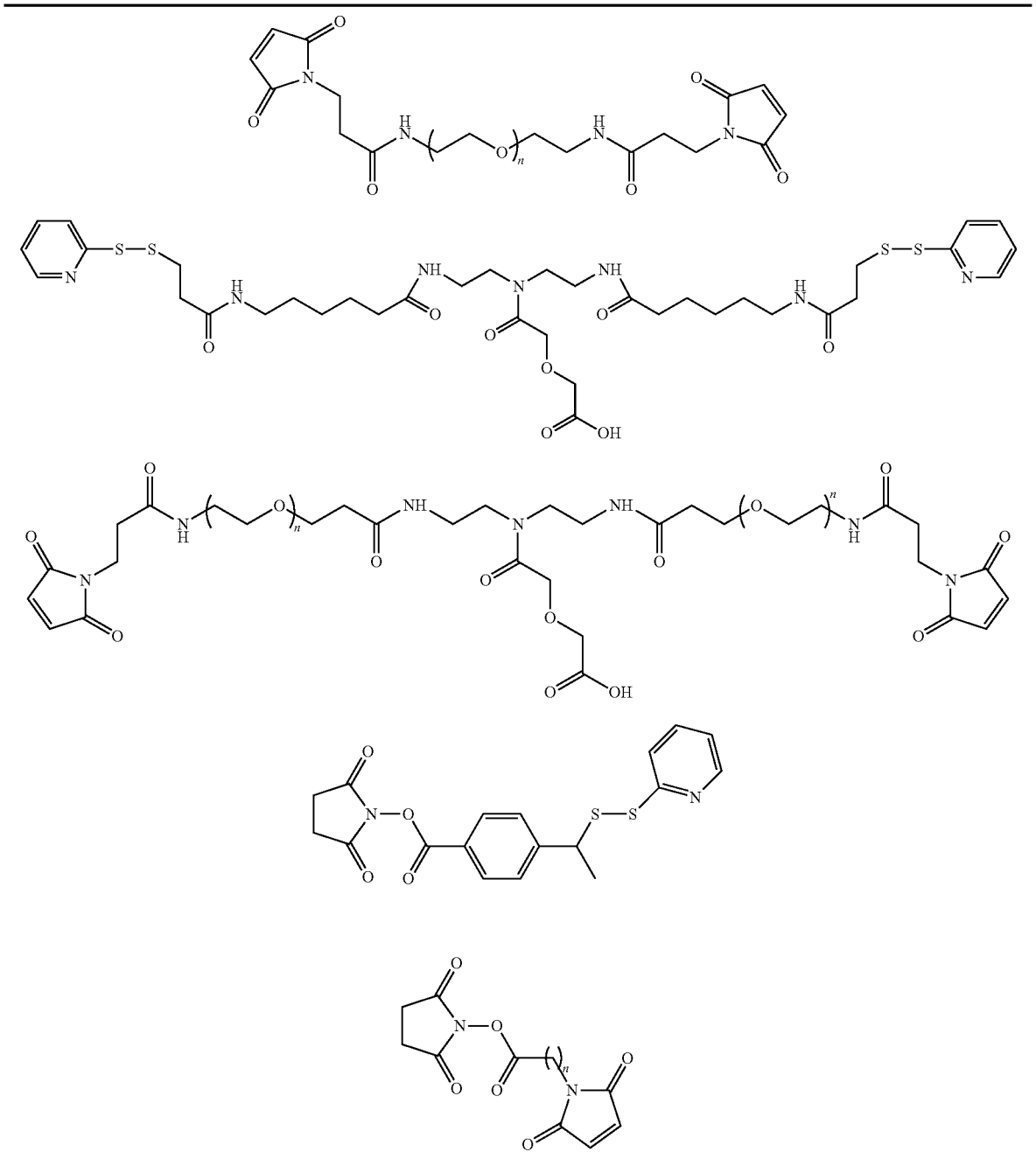

R = H, Boc, Cbz, Ac, PEG, lipid, targeting ligand, linker(s) and/or peptide(s).
n = 0 to 750.
"nucleotide" can be substituted with non-nucleotide moiety such as abasic or linkers as are generally known in the art.
enzymatically cleavable linker = linker cleaved by enzyme; e.g., protease or glycosidase In another embodiment, the preferred linkers are shown in Table 2.

TABLE 2

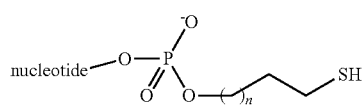

TABLE 2-continued
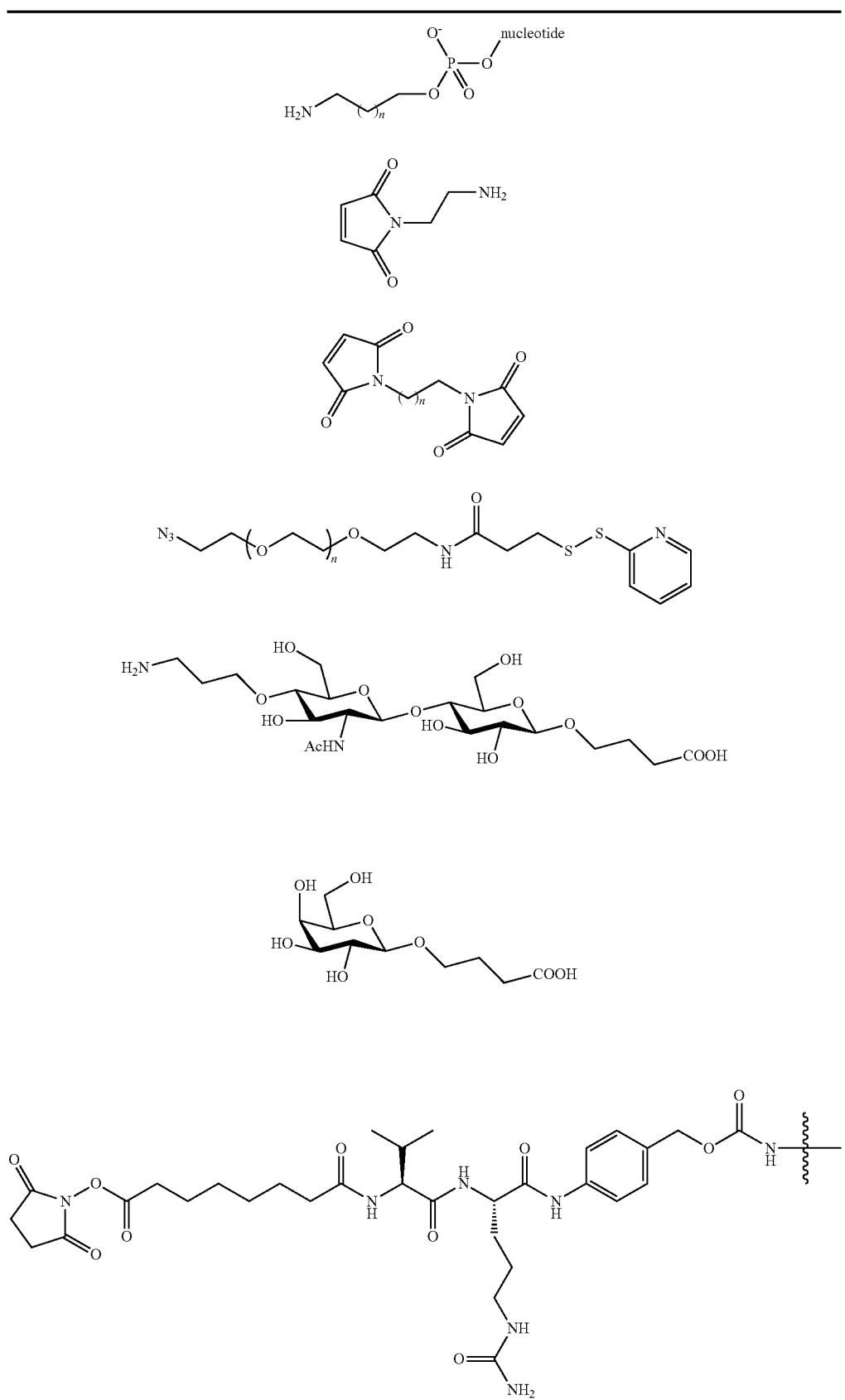

TABLE 2-continued

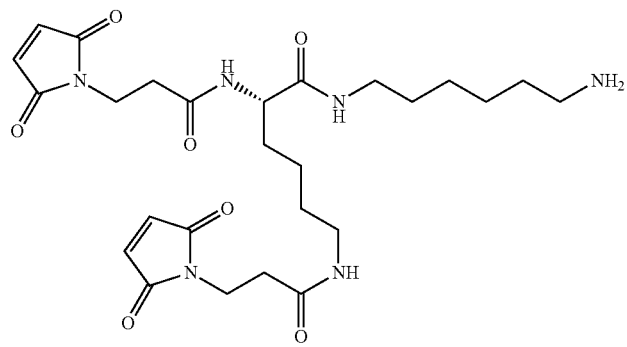

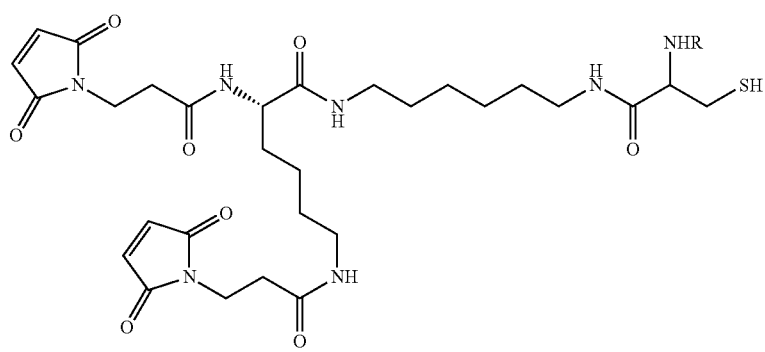

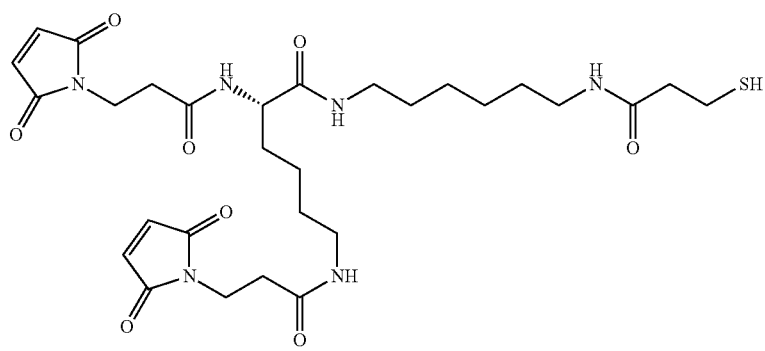 [SMILES: O=C(CCS)NCCCCCCNC(=O)[C@H](CCCCNC(=O)CCN1C(=O)C=CC1=O)NC(=O)CCN1C(=O)C=CC1=O]

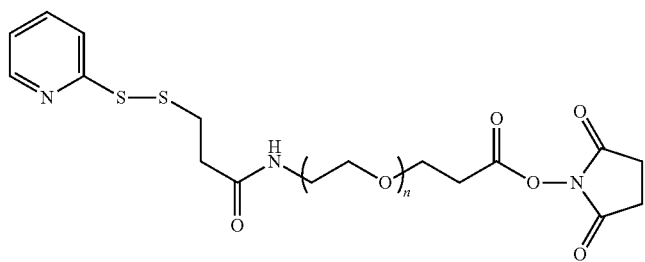

R = H, Boc, Cbz, Ac, PEG, lipid, targeting ligand, linker(s) and/or peptide(s).
n = 0 to 750.
"nucleotide" can be substituted with non-nucleotide moiety such as abasic or linkers as are generally known in the art.
enzymatically cleavable linker = linker cleaved by enzyme; e.g., protease or glycosidase Commercial linkers are available from various suppliers such as Pierce or Quanta Biodesign including combinations of said linkers. In addition, commercial linkers attached via phosphate bonds can be used independently as linkers or in combination with said linkers. The linkers may also be combined to produce more complex branched architectures accommodating from 1 to 8 peptides as illustrated in one such example below:

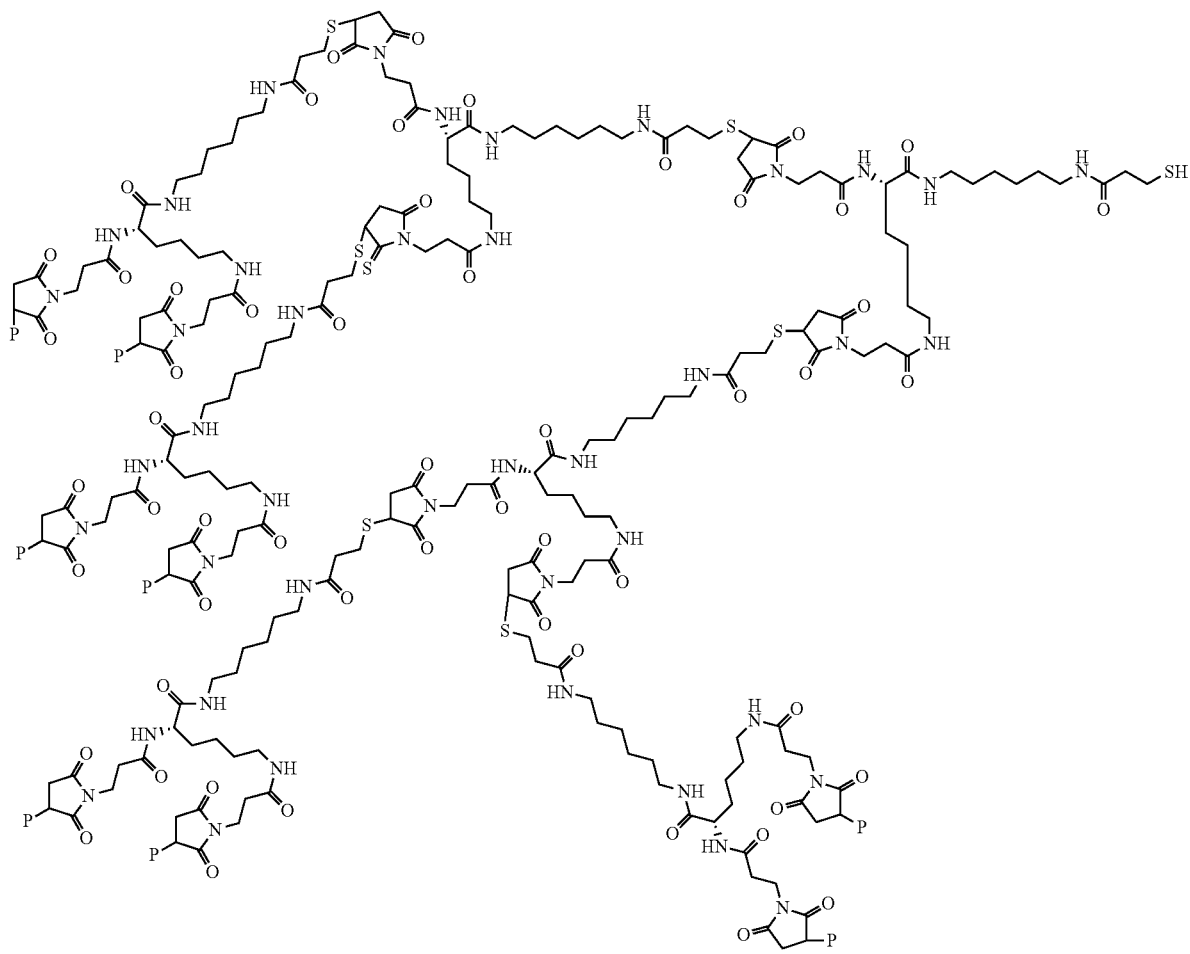

Peptides

For macromolecular drugs and hydrophilic drug molecules, which cannot easily cross bilayer membranes, entrapment in endosomal/lysosomal compartments of the cell is thought to be the biggest hurdle for effective delivery to their site of action. Without wishing to be bound by theory, it is believed that the use of peptides will facilitate oligonucleotide escape from these endosomal/lysosomal compartments or oligonucleotide translocation across a cellular membrane and release into the cytosolic compartment. In certain embodiments, the peptides of the present invention may be polycationic or amphiphilic or polyanionic or zwitterionic or lipophilic or neutral peptides or peptidomimetics which can show pH-dependent membrane activity and/or fusogenicity. A peptidomimetic may be a small protein-like chain designed to mimic a peptide.

In some embodiments, the peptide is a cell-permeation agent, preferably a helical cell-permeation agent. These peptides are commonly referred to as Cell Penetrating Peptides. See, for example, "Handbook of Cell Penetrating Peptides" Ed. Langel, U.; 2007, CRC Press, Boca Raton, Fla. Preferably, the component is amphipathic. The helical agent is preferably an alpha-helical agent, which preferably has a lipophilic and a lipophobic phase. A cell-permeation agent can be, for example, a cell permeation peptide, cationic peptide, amphipathic peptide or hydrophobic peptide, e.g. consisting primarily of Tyr, Trp and Phe, dendrimer peptide, constrained peptide or crosslinked peptide. Examples of cell penetrating peptides include Tat, Penetratin, and MPG. For the present invention, it is believed that the cell penetrating peptides can be a "delivery" peptide, which can carry large polar molecules including peptides, oligonucleotides, and proteins across cell membranes. Cell permeation peptides can be linear or cyclic, and include D-amino acids, "retro-inverso" sequences, nonpeptide or pseudo-peptide linkages, peptidyl mimics. In addition the peptide and peptide mimics can be modified, e.g. glycosylated, pegylated, or methylated. Examples and a further discription of peptides can be found in WO2009/126933, which is hereby incorporated by reference. Synthesis of peptides is well known in the art.

The peptides may be conjugated at either end or both ends by addition of a cysteine or other thiol containing moiety to the C- or N-terminus. When not functionalized on the N-terminus, peptides may be capped by an acetyl group, or may be capped with a lipid, a PEG, or a targeting moiety. When the C-terminus of the peptides is unconjugated or unfunctionalized, it may be capped as an amide, or may be capped with a lipid, a PEG, or a targeting moiety.

Suitable peptides that can be used in the conjugates disclosed herein are listed in Table 3 below:

TABLE 3

| Peptide Sequence Listing and ID | |
|---|---|
| Sequence | SEQ ID |
| CGLFEAIEEFIENLWELLIDGWYGYGRKKRRQRR | SEQ ID NO: 1 |
| CGLFEAIEGFIENGWEGMIDGWYGYGHKKHHQHH | SEQ ID NO: 2 |
| C-bAla-LFEAIEGFIENGWEGMIDGWYGYGRKKRRQRR | SEQ ID NO: 3 |
| CGLFEAIEGFIENGLKGLIDWWYGYGRKKRRQRR | SEQ ID NO: 4 |
| CGLFEAIEGFIEWGWEGMIDGWYGYGRKKRRQRR | SEQ ID NO: 5 |
| CRRQRRKKRGYGYWGDIMGEWGNEIFGEIAEFLG | SEQ ID NO: 6 |
| CGLFEAIEGFIENGWEGMIDGWYGYGRKKRRQR | SEQ ID NO: 7 |
| CYGRKKRRQRRGLFEAIEGFIENGWEGMIDGWYG | SEQ ID NO: 8 |
| CIFGAIAGFIKNILKGLIDG | SEQ ID NO: 9 |
| CIFGAIAGFIRNIW | SEQ ID NO: 10 |
| CGLFHALLHLLHSLWHGLLHAWYGYGHKKHHQHR | SEQ ID NO: 11 |
| CGLFEAIEGLIENGWEGMIDGWYGYGRKKRRQRR | SEQ ID NO: 12 |
| CGLFELIEGFIENGWEGMIDGWYGYGRKKRRQRR | SEQ ID NO: 13 |
| CGLFEAIEGFIENGWEGLIDGWYGYGOOOOOQRR (O = ornithine) | SEQ ID NO: 14 |
| CGLFGAIEGFIENGWEGLIDGWYGYGRKKRRQRR | SEQ ID NO: 15 |
| CGLFEAIEGFLENGWEGMIDGWYGYGRKKRRQRR | SEQ ID NO: 16 |
| CGLFEAIEGFIENGLEGMIDGWYGYGRKKRRQRR | SEQ ID NO: 17 |
| CGLFGAIEGFIENGWEGMIDGWYGYGRKKRRQRR | SEQ ID NO: 18 |
| CGLFEAIEGFIENGWEG-Nle-IDGWYGYGRKKRRQRR | SEQ ID NO: 19 |
| CGIFGAIAGFIKNIWKGLIDW | SEQ ID NO: 20 |
| CYGRKKRRQRRGLFEAIEGFIENGWKGLIDAWYG | SEQ ID NO: 21 |
| CGLLEALEGLLESLWEGLLEAWYGYGRKKRRQRR | SEQ ID NO: 22 |
| CGLFEAIEGFIENGWEGMIDNWYGYGRKKRRQRR | SEQ ID NO: 23 |
| CIFGAIAGFIKNIWEGLIEAWYGLHLLHHLLHHLHHLLHHLLHL | SEQ ID NO: 24 |
| CIFGAIAGFIKNIWEGLIDAF | SEQ ID NO: 25 |
| CIFGAIAGFIKNIWEGLI | SEQ ID NO: 26 |
| CGLFEAIEGFIENGWEGMIDGWYGYGRKKRRQRRK(stearyl) | SEQ ID NO: 27 |
| CGLFEAIAGFIEGGWPGLINGWYGYGRKKRRQRRLHLLHHLLHHLHHLLHHLLHHLLHHL | SEQ ID NO: 28 |
| CGLFEAIEGFIENGWEGMIDGWYGGGGLHLLHHLLHHLHHLLHHLLHLLHHLLHHL | SEQ ID NO: 29 |
| CGLFEAIEGFIENGWEGMIDGWYGLHLLHHLLHHLHHLLHHLLHL | SEQ ID NO: 30 |
| CGLFEALLELLESLWELLLEAYGRKKRRQRR | SEQ ID NO: 31 |
| CGLFEAIEGFIENGWEGMIDGWYGYGRKKRRQRR | SEQ ID NO: 32 |
| CGLFEAIEGFIENGWEGMADGWYGYGRKKRRQRR | SEQ ID NO: 33 |
| CGIFGAIAGFIKNIWEGLIDWWYGYGRKKRRQRR | SEQ ID NO: 34 |
| CGFLPAIAGILSQLFEGLIDGWYGYGRKKRRQRR | SEQ ID NO: 35 |
| CFFGAIWGFIKSIL | SEQ ID NO: 36 |
| CIFGAIAGFIKNIWKGLIDWWYG | SEQ ID NO: 37 |

TABLE 3-continued

Peptide Sequence Listing and ID

| Sequence | SEQ ID |
|---|---|
| CGLFEAIEGFIWNGWEGMIDGWYGYGRKKRRQRR | SEQ ID NO: 38 |
| CGLFEAIAEFIENGWEGMIDGWYGYGRKKRRQRR | SEQ ID NO: 39 |
| CYGRKKRRQRRGLFEAIEGFIENGWKGLIDWWYG | SEQ ID NO: 40 |
| CGLFEAIEGFIEEGWEGMIDGWYGYGRKKRRQRR | SEQ ID NO: 41 |
| CGLFEAIEGFIENAWEGMIDGWYGYGRKKRRQRR | SEQ ID NO: 42 |
| CGLFEAIEGFIENGWEGMIDLWYGYGRKKRRQRR | SEQ ID NO: 43 |
| CRLLRLLLRLWRRLLRLLR | SEQ ID NO: 44 |
| CGGFEAIEGFIENGWEGMIDGWYGYGRKKRRQRR | SEQ ID NO: 45 |
| CGLFEKIEGFIENGWEGMIDGWYGYGRKKRRQRR | SEQ ID NO: 46 |
| CGLFEAIEGFIENGWENMIDGWYGYGRKKRRQRR | SEQ ID NO: 47 |
| CIFGAIAGFIKNILKGL | SEQ ID NO: 48 |
| CIFGAIAGFIKNILKGLIDGWYG | SEQ ID NO: 49 |
| CGLFEAIEGFIENGWEGMIDGWYG-(PEG)3-YGRKKRRQRR | SEQ ID NO: 50 |
| CGLFEALLELLESLWELLLEAYGRKKRRQRRLHLLHHLLHHLLHHLLHHLLHL | SEQ ID NO: 51 |
| CYGRKKRRQRRWEAALAEALAEALAEHLAEALAEALEALAA | SEQ ID NO: 52 |
| CIFGAIAGFIKNIWEGLIDGWYGKLALKLALKALKAALKLA | SEQ ID NO: 53 |
| CFFGAIWEFIRSILEGLIDGWYGYGRKKRRQRR | SEQ ID NO: 54 |
| CGLFHALLHLLHSLWHLLLHAWYGYGRKKRRQRR | SEQ ID NO: 55 |
| CGLFHALLHLLHSLWHLLLHAWYGYGHKKHHQHR | SEQ ID NO: 56 |
| CGLFGALLELLESLWKGLLEWYGRKKRRQRR | SEQ ID NO: 57 |
| CRRQRRKKRGYGYWGDILGEWGNEIFGEIAEFLG | SEQ ID NO: 58 |
| CGLFEALEGFLENGWEGLLDGWYGYGROORRQRR (O = ornithine) | SEQ ID NO: 59 |
| CGLFGEIEELIENGLKNLIDWWYGYGRKKRRQRR | SEQ ID NO: 60 |
| CRRQRRKKRGYGYWWDILGKWGNEIFGEIAEFLG all (D) aminos | SEQ ID NO: 61 |
| CGIFGAIAGFIKNIL | SEQ ID NO: 62 |
| CGIFGAIAGLLKNIFK | SEQ ID NO: 63 |
| CIFGAIAGFIKNIWKGLIDW | SEQ ID NO: 64 |
| CIFGAIAGFIKNIWK | SEQ ID NO: 65 |
| CGLFEEIEGFIENGWEGLIDWWYGYGHKKHHQHR | SEQ ID NO: 66 |
| CGLFGEIEELIENGLKNLIDWWYGYGHKKHHQHR | SEQ ID NO: 67 |
| CGLFEEIEEFIENGWEGLIDWWYGYGHKKHHQHR | SEQ ID NO: 68 |
| stearyl-WEAALAEALAEALAEHLAEALAEALEALAAYGRKKRRQRRC | SEQ ID NO: 69 |
| CGLFEAIEGFIENGWKGLIDGWYGGLFEAIEGFIENGWKGLIDWWYG | SEQ ID NO: 70 |
| CGFFHAFFHFFHSFWHGFFEA | SEQ ID NO: 71 |
| CGNFGEIEELIEEGLENLIDWWNG | SEQ ID NO: 72 |
| CFFGAIWEFIRNILEGF | SEQ ID NO: 73 |
| CFFGAIWEFIHSIL | SEQ ID NO: 74 |
| CGLFHALLHLLHSLWHGLLEA | SEQ ID NO: 75 |

TABLE 3-continued

Peptide Sequence Listing and ID

| Sequence | SEQ ID |
|---|---|
| CIFGAIAGFIKNIWEGL | SEQ ID NO: 76 |
| CIFGAIAGLLKNIFEGLIDGWYGYGRKKRRQRR | SEQ ID NO: 77 |
| CGFIGAIANLLSKIFEGLIDGWYGYGRKKRRQRR | SEQ ID NO: 78 |
| CGLFEAIEELIENLWKGLIDAWYGYGRKKRRQRR | SEQ ID NO: 79 |
| CGIFGAIAGLLKNIFKGLIDA | SEQ ID NO: 80 |
| CGIFGAIAGLLKNIFKGLIDW | SEQ ID NO: 81 |
| CGIFEAIAGLLKNIFK | SEQ ID NO: 82 |
| CGIFEEIAGLLKNIFK | SEQ ID NO: 83 |
| CGLFEAIAGFIEGGWPGLINGWYGYGRKKRRQRRLHLLHHLLHHLHHLLHHLL HL | SEQ ID NO: 84 |
| CGLFEAIEGFIENGWKGMIDWWYGYGRKKRRQRRK(stearyl) | SEQ ID NO: 85 |
| CGLFGEIEEFIENGWKGLIDWWYG | SEQ ID NO: 86 |
| CIFGAIAGFIKNIWLHLLHHLLHHLHHLLHHLLHL | SEQ ID NO: 87 |
| CGIFGAIEGFIENGWKGLIDAWYGYRKKRRQRR | SEQ ID NO: 88 |
| CELFGAIEGFIENGWKGLIDWWYGYGRKKRRQRR | SEQ ID NO: 89 |
| CIFGIDDLIIGLLFVAIVEAGIGGYLLGSYGRKKRRQRR | SEQ ID NO: 90 |
| GLFGALAEALAEALAEHLAEALAEALEALAAGGSC | SEQ ID NO: 91 |
| CGFIGAIANLLSKIFEGLIDGWYGYGRKKRRQRR all (D) | SEQ ID NO: 92 |
| CFFGAIWEFIRSILKGLI | SEQ ID NO: 93 |
| CFFGAIWEFIRSILK | SEQ ID NO: 94 |
| CFFGAIWEFIRSILE | SEQ ID NO: 95 |
| CIFGAIAGFIKNIWE | SEQ ID NO: 96 |
| CIFGAIAGFIKNIWKGLIDA | SEQ ID NO: 97 |
| CFFEAIEEFIKNILK | SEQ ID NO: 98 |
| CIFGAIAGLLRNIF | SEQ ID NO: 99 |
| CGIFGAIAGLLKNIW | SEQ ID NO: 100 |
| CLFGAIWEFIKSIL | SEQ ID NO: 101 |
| CFWGAIWEFIKSIL | SEQ ID NO: 102 |
| CFGGAIWEFIKSIL | SEQ ID NO: 103 |
| CFAGAIWEFIKSIL | SEQ ID NO: 104 |
| CGLFEAIEGFIENGWEGM(SO2)IDGWYGYGRKKRRQRR | SEQ ID NO: 105 |
| CGLFEAIEGFIENGWEGMIDWWYGYGRKKRRQRR | SEQ ID NO: 106 |
| CFFGAIWEFIKSIG | SEQ ID NO: 107 |
| CFFGAIWEFIKSIA | SEQ ID NO: 108 |
| CFFGAIWEFIKSIN | SEQ ID NO: 109 |
| CFFGAIWEFIKSIW | SEQ ID NO: 110 |
| CFFGAIWEFIKSILEGLIDWWYGYGHKKHHQHR | SEQ ID NO: 111 |
| Ac-CLHLLHHLLHHLHHLLHHLLHLLHHLLHHH-NH2 | SEQ ID NO: 112 |
| Ac-LHLLHHLLHHHLHHLLHHLLHLLHHLLHHLGGGRKKRRQRRRPPQC-NH2 | SEQ ID NO: 113 |

TABLE 3-continued

Peptide Sequence Listing and ID

| Sequence | SEQ ID |
|---|---|
| CRKKRRQRRRPPQGGGLHLLHHLLHHLHHLLHHLLHLLHHLLHHL | SEQ ID NO: 114 |
| CLHLLHHLLHHLHHLLHHLLHLLHHLLHHLGGGRKKRRQRRRPPQ | SEQ ID NO: 115 |
| CGLFHAIAHFIHGGWHGLIHGWYGYGRKKRRQRR | SEQ ID NO: 116 |
| CGLFKAIAKFIKGGWKGLIKGWYGYGRKKRRQRR | SEQ ID NO: 117 |
| CGLFEAIAGFIENGWEGMIDGWYGYGRKKRRQRR | SEQ ID NO: 118 |
| CWEAALAEALAEALAEHLAEALAEALEALAAYGRKKRRQRR | SEQ ID NO: 119 |
| CGLFEAIEGFIENGWEGMIDGWYGRKKRRQRRRPPQ | SEQ ID NO: 120 |
| GLFEAIEGFIENGWEGMIDGWYGYGRKKRRQRRC | SEQ ID NO: 121 |
| Ac-LHLLHHLLHHLHHLLHHLLHLLHHLLHHLRKKRRQRRRPPQ-NH2 | SEQ ID NO: 122 |
| Ac-LHLLHHLLHHLHHLLHHLLHLLHHLLHHLGPGRKKRRQRRRPPQ-NH2 | SEQ ID NO: 123 |
| Ac-LIRLWSHLIHIWFQNRRLKWKKK-NH2 | SEQ ID NO: 124 |
| Ac-RKKRRQRRRPPQQQQQQ-NH2 | SEQ ID NO: 125 |
| Ac-GLFEAIEGFIENGWEGMIDGWYGYGRKKRRQRR-NH2 | SEQ ID NO: 126 |
| Ac-LHLLHHLLHHLHHLLHHLLHLLHHLLHHLGGGRRRRRRRRR-NH2 | SEQ ID NO: 127 |
| Ac-LHLLHHLLHHLHHLLHHLLHLLHHLLHHL-(Peg)12-RKKRRQRRRPPQ-NH2 | SEQ ID NO: 128 |
| Ac-GLFGAIAGFIENGWEGMIDGWYGLIRLWSHLIWFQNRRLKWLLL-NH2 | SEQ ID NO: 129 |
| Ac-HHHHHRKKRRQRRRPPQGGGLHLLHHLLHHLHHLLHHLLHLLHHLLHHL-NH2 | SEQ ID NO: 130 |
| Ac-LHLLHHLLHHLHHLLHHLLHLLHHLLHHL-(Peg)2-RKKRRQRRRPPQ-NH2 | SEQ ID NO: 131 |
| Ac-LHLLHHLLHHLHHLLHHLLLLHHLLHHLGGGRQIKIWFQNRRMKWKKGG-NH2 | SEQ ID NO: 132 |
| Ac-KLLKLLLKLWLKLLKLLLKLLGGGRKKRRQRRRPPQ-NH2 | SEQ ID NO: 133 |
| Ac-LHHLLHHLLHHLHHLLHHHLHHLLHHLLHLC-NH2 all (D) | SEQ ID NO: 134 |
| Ac-LHLLHHLLHHLHHLLHHLLHLLHHLLHHL-PEG6-RKKRRQRRRPPQC-NH2 | SEQ ID NO: 135 |
| Ac-GLFEAIEGFIENGWEGMIDGWYGYGRKKRRQRRC-NH2 | SEQ ID NO: 136 |
| CGLFEAIEGFIENGWEGMIDGWYGYGRKKRRQRR all (D) | SEQ ID NO: 137 |
| CGLFEAIEGFIENGWEGMIDGWYGYGRRRRRRRRR-NH2 | SEQ ID NO: 138 |
| YGRKKRRQRRGLFEAIEGFIENGWEGMIDGWYGC-NH2 | SEQ ID NO: 139 |
| CGVFVLGFLGFLATAGSYGRKKRRQRR-NH2 | SEQ ID NO: 140 |
| CGLFKAIAKFIKGGWKGLIKGWYG-NH2 | SEQ ID NO: 141 |
| CGLFEAIEGFIENGWEGMIDGWYGYGRKKR | SEQ ID NO: 142 |
| CGLFEAIEGFIENGWEGMIDGWYGYGRKKRRQRRYGRKKRRQRR | SEQ ID NO: 143 |
| CGLFEAIEGFIENGWEGMIDGWYGYGRKKRRQRRYGRKKRRQRR | SEQ ID NO: 144 |
| CGLFEAIKGFIENGWEGMIDGWYGYGRKKRRQRR | SEQ ID NO: 145 |
| CGLFEAIHGFIENGWEGMIDGWYGYGRKKRRQRR | SEQ ID NO: 146 |
| CGLFEAIRGFIENGWEGMIDGWYGYGRKKRRQRR | SEQ ID NO: 147 |
| CGLFEAIDGFIENGWEGMIDGWYGYGRKKRRQRR | SEQ ID NO: 148 |
| CRLFEAIEGFIENGWEGMIDGWYGYGRKKRRQRR | SEQ ID NO: 149 |
| CGGGLFEAIEGFIENGWEGMIDGWYGYGRKKRRQRR | SEQ ID NO: 150 |

TABLE 3-continued

Peptide Sequence Listing and ID

| Sequence | SEQ ID |
|---|---|
| CGLFEAIEGFIENGWEGMIDGWYGGGGYGRKKRRQRR | SEQ ID NO: 151 |
| CGLFEAIEGFIENGWEGMIDGWYG-(PEG)11-YGRKKRRQRR | SEQ ID NO: 152 |
| CFLGFLLGVGSAIASGIAVSKVLHL | SEQ ID NO: 153 |
| CGVFVLGFLGFLATAGSAMGARSLTLSAYGRKKRRQRR | SEQ ID NO: 154 |
| Ac-GLWRALWRLLRSLWRLLWRA-mercaptoethylamide | SEQ ID NO: 155 |
| C-Nle-LFEAIEGFIENGWEGMIDGWYGYGRKKRRQRR | SEQ ID NO: 156 |
| CELFEAIEGFIENGWEGMIDGWYGYGRKKRRQRR | SEQ ID NO: 157 |
| CGFFGAIAGFLEGGWEGMIAGWHGYGRKKRRQRR | SEQ ID NO: 158 |
| CFLGFLLGVGSAIASGIAVSKVLHLYGRKKRRQRR | SEQ ID NO: 159 |
| GLFEAIEGFIENGWEGLAEALAEALEALAAGGSC | SEQ ID NO: 160 |
| CGLFEAIEGFIENGWEGMIDGWYGLHLLHHLLHHLHHLLHLLHHLLHHL | SEQ ID NO: 161 |
| CGLFEAIEGFIENGWEGMIDGWYGYGRKKRRQRRLHLLHHLLHHLHHLLHHLLHLLHHLLHHL | SEQ ID NO: 162 |
| CGLFGAIAGFIEGGWTGMIDGWYGYGRKKRRQRR | SEQ ID NO: 163 |
| CGLFGAIAGFIEGGWQGMVDGWYGYGRKKRRQRR | SEQ ID NO: 164 |
| CGLFGAIAGFIENGWQGLIDGWYGYGRKKRRQRR | SEQ ID NO: 165 |
| CGLFGAIAGFIENGWEGLVDGWYGYGRKKRRQRR | SEQ ID NO: 166 |
| CGLFGAIAGFIEGGWSGMIDGWYGYGRKKRRQRR | SEQ ID NO: 167 |
| CGLFGAIAGFIEGGWPGLVAGWYGYGRKKRRQRR | SEQ ID NO: 168 |
| CGLFGAIAGFIENGWEGMVDGWYGYGRKKRRQRR | SEQ ID NO: 169 |
| CGLFGAIAGFIEGGWPGLINGWYGYGRKKRRQRR | SEQ ID NO: 170 |
| CGLFGAIAGFIENGWEGLIDGWYGYGRKKRRQRR | SEQ ID NO: 171 |
| CGLFGAIAGFIENGWEGMIDGWYGYGRKKRRQRR | SEQ ID NO: 172 |
| CGLFGAIAGFIENGWEGMIDGWYGSSKKKK | SEQ ID NO: 173 |
| CGLFGAIAGFIENGWEGLIDGWYGYGRKKRRQRR | SEQ ID NO: 174 |
| CGLFEAIAGFIENGWEGLIDGWYGYGRKKRRQRR | SEQ ID NO: 175 |
| CGLFGAIAGFIENGWEGLIEGWYGGGRKKRRQRR | SEQ ID NO: 176 |
| CGLFEAIAGFIENGWEGLIDGWYGGGRKKRRQRR | SEQ ID NO: 177 |
| CGLFEAIAGFIENGWEGLIDGWYGYGRKKRRQRR | SEQ ID NO: 178 |
| CGLFEAIAEFIENGWEGLIEGWYGGRKKRRQRR | SEQ ID NO: 179 |
| CGLFEAIEGFIENGWEGMIDGWYGRKKRRQRRR | SEQ ID NO: 180 |
| CKLLKLLLKLWLKLLKLLLKLL | SEQ ID NO: 181 |
| CKLLKLLLKLWLKLLKLLLKLLYGRKKRRQRR | SEQ ID NO: 182 |
| GLFEAIEGFIENGWEGMIDGWYGC | SEQ ID NO: 183 |
| CVLFEAIEGFIENGWEGMIDGWYGYGRKKRRQRR | SEQ ID NO: 184 |
| CSLFEAIEGFIENGWEGMIDGWYGYGRKKRRQRR | SEQ ID NO: 185 |
| CGLFEAIEGFIENGWEGMIDGWYGYGRKKRRQ | SEQ ID NO: 186 |
| CGLFEAIEGFIENGWEGMIDGWYGYGRKKRR | SEQ ID NO: 187 |

TABLE 3-continued

Peptide Sequence Listing and ID

| Sequence | SEQ ID |
|---|---|
| CGLFEAIEGFIENGWEGMIDGWYGKKKKKQKK | SEQ ID NO: 188 |
| CGLFEAIEGFIENGWEGMIDGWYGGLFEAIEGFIENGWEGMIDGWYG | SEQ ID NO: 189 |
| CGLFEAIEGFIENGWEGMIDGWYGYGRKKRRQRRGLFEAIEGFIENGWEGMIDGWYGYGRKKRRQRR | SEQ ID NO: 190 |
| RRQRRKKRGYGYWGDIMGEWGNEIFGEIAEFLGC | SEQ ID NO: 191 |
| CRRQRRKKRGYGYWGDIMGEWGNEIFGEIAEFLG | SEQ ID NO: 192 |
| GLFEAIEGFIENGWEGMIDGWYGYGRK-K(D)-RRQRR | SEQ ID NO: 193 |
| GLFEAIEGFIENGWEGMIDGWYGYGRKK-R(D)-RQRR | SEQ ID NO: 194 |
| GL-F(D)-EAIEGFIENGWEGMIDGWYGYGRKKRRQRR | SEQ ID NO: 195 |
| GLF-E(D)-AIEGFIENGWEGMIDGWYGYGRKKRRQRR | SEQ ID NO: 196 |
| CGLFEAIEGFIENGWEGMIDGWYG | SEQ ID NO: 197 |
| CYGRKKRRQRR | SEQ ID NO: 198 |
| YGRKKRRQRRC | SEQ ID NO: 199 |
| RRQRRKKRGYGYWGDIMGEWGNEIFGEIAEFLGC all(D) | SEQ ID NO: 200 |
| CRRQRRKKRGYGYWGDIMGEWGNEIFGEIAEFLG all(D) | SEQ ID NO: 201 |
| CGLFEAIEGFIENGWEGMIDGAYGYGRKKRRQRR | SEQ ID NO: 202 |
| CGLFEALLELLESLWELLLEAWYGYGRKKRRQRR | SEQ ID NO: 203 |
| CGLFEAIEGFNENGWEGMIDGWYGYGRKKRRQRR | SEQ ID NO: 204 |
| CGLFEAIEGFIENEWEGMIDGWYGYGRKKRRQRR | SEQ ID NO: 205 |
| K(stearoyl)GLFEAIEGFIENGWEGMIDGWYGYGRKKRRQRRC | SEQ ID NO: 206 |
| CGLFEAIK(stearoyl)GFIENGWEGMIDGWYGYGRKKRRQRR | SEQ ID NO: 207 |
| CGLFEAIKGFIENGWEGMIDGWYGYGRK(stearoyl)KRRQRR | SEQ ID NO: 208 |
| CGLFEAIEGFIENPWEGMIDGWYGYGRKKRRQRR | SEQ ID NO: 209 |
| (stearyl)GLFEAIEGFIENPWEGMIDGWYGYGRKKRRQRRC | SEQ ID NO: 210 |
| CGLFGAIAGFIEGGWPGLINGWYGYGRKKRRQRRLHLLHHLLHHLHHLLHHLLHLLHHLLHHL | SEQ ID NO: 211 |
| CGLFGAIAGFIEGGWPGLINGWYGYGRKKRRQRRLHLLHHLLHHLHHLLHHLLHL | SEQ ID NO: 212 |
| CGLFEAIAGFIEGGWPGLINGWYGYGRKKRRQRR | SEQ ID NO: 213 |
| CGLEEAIEGFIENGWEGMIDGWYGYGRKKRRQRR | SEQ ID NO: 214 |
| CGLFNAIEGFIENGWEGMIDGWYGYGRKKRRQRR | SEQ ID NO: 215 |
| CGLFAAIEGFIENGWEGMIDGWYGYGRKKRRQRR | SEQ ID NO: 216 |
| CGLFEAIENFIENGWEGMIDGWYGYGRKKRRQRR | SEQ ID NO: 217 |
| CGLFEAIEKFIENGWEGMIDGWYGYGRKKRRQRR | SEQ ID NO: 218 |
| CGLFEAIEGFAENGWEGMIDGWYGYGRKKRRQRR | SEQ ID NO: 219 |
| CGLFEAIEGFIENWWEGMIDGWYGYGRKKRRQRR | SEQ ID NO: 220 |
| CGLFEAIEGFIENNWEGMIDGWYGYGRKKRRQRR | SEQ ID NO: 221 |
| CGLFEAIEGFIENGEEGMIDGWYGYGRKKRRQRR | SEQ ID NO: 222 |
| CGLFEAIEGFIENGWAGMIDGWYGYGRKKRRQRR | SEQ ID NO: 223 |
| CGLFEAIEGFIENGWNGMIDGWYGYGRKKRRQRR | SEQ ID NO: 224 |

TABLE 3-continued

Peptide Sequence Listing and ID

| Sequence | SEQ ID |
|---|---|
| CGLFEAIEGFIENGWGGMIDGWYGYGRKKRRQRR | SEQ ID NO: 225 |
| CGLFEAIEGFIENGWEGMIDAWYGYGRKKRRQRR | SEQ ID NO: 226 |
| CGLFEAIEGFIENGWLGMIDGWYGYGRKKRRQRR | SEQ ID NO: 227 |
| CGLFEAIEGFIENGWKGMIDGWYGYGRKKRRQRR | SEQ ID NO: 228 |
| CGLFEAIEGFIENGWEGMIDKWYGYGRKKRRQRR | SEQ ID NO: 229 |
| CGLFEAIEGFIENGWEGMIDEWYGYGRKKRRQRR | SEQ ID NO: 230 |
| CGLFEAIEGFIENGWEGMIDGLYGYGRKKRRQRR | SEQ ID NO: 231 |
| CGLFEAIEGFIENGWEGMIDGNYGYGRKKRRQRR | SEQ ID NO: 232 |
| CGLFEAIEGFIENGWEGMIDGKYGYGRKKRRQRR | SEQ ID NO: 233 |
| CGLFEAIEGFIENGWEGMIDGEYGYGRKKRRQRR | SEQ ID NO: 234 |
| CGLFEALEELLEGGWEGLIEAWYGYGRKKRRQRR | SEQ ID NO: 235 |
| CELFGAIWEFIEGGWEGLIEAWYGYGRKKRRQRR | SEQ ID NO: 236 |
| CGLFEALEEFIEGGWEGLLEAWYGYGRKKRRQRR | SEQ ID NO: 237 |
| CGLFEALEEFIENGWEGLLEAWYGYGRKKRRQRR | SEQ ID NO: 238 |
| CGLFEAIEGFIESGWEGLIDGWYGYGRKKRRQRR | SEQ ID NO: 239 |
| CGLFEAIEEFIEGGWEGLIEAWYGYGRKKRRQRR | SEQ ID NO: 240 |
| CGLFEAIEGFIENGWEGLIDAWYGYGRKKRRQRR | SEQ ID NO: 241 |
| CGLFEAIEGFILNGWEGMIDGWYGYGRKKRRQRR | SEQ ID NO: 242 |
| CGLFEAIEGFIKNGWEGMIDGWYGYGRKKRRQRR | SEQ ID NO: 243 |
| CGLFEAIEGFIGNGWEGMIDGWYGYGRKKRRQRR | SEQ ID NO: 244 |
| CGLFEAIEGFIELGWEGMIDGWYGYGRKKRRQRR | SEQ ID NO: 245 |
| CGLFEAIEGFIEKGWEGMIDGWYGYGRKKRRQRR | SEQ ID NO: 246 |
| CGLFEAIAEFIEGGWEGLIEGWYGYGRKKRRQRR | SEQ ID NO: 247 |
| CRGWEVLKYWWNLLQY | SEQ ID NO: 248 |
| CRGWEVLKYWWNLLQYYGRKKRRQRR | SEQ ID NO: 249 |
| CGLFGAIAGFIENGWEGMIDGWYGFRYGRKKRRQRR | SEQ ID NO: 250 |
| Ac-CGLFEAIEGFIENGWEGMIDGWYGYGRKKRRQRR-CO2H | SEQ ID NO: 251 |
| CGLLEALEGLLENGWEGLLEAWYGYGRKKRRQRR | SEQ ID NO: 252 |
| CLRHLLRHLLRHLRHLLRHLRHLLRHLLRH | SEQ ID NO: 253 |
| CGIFEAIEGFIENGWEGIIDGWYGYGROORRQRR (O = ornithine) | SEQ ID NO: 254 |
| CGIGAVLKVLTTGLPALISWIKRKRQQ | SEQ ID NO: 255 |
| CGIGAVLKVLTTGLPALISWIHHHHQQ | SEQ ID NO: 256 |
| CGAFEAIEGFIENGWEGMIDGWYGYGRKKRRQRR | SEQ ID NO: 257 |
| Ac-LHLLHHLLHHLHHLLHHLLHLLHHLLHHLRRRRR | SEQ ID NO: 258 |
| CGLFGAIWFIENWWKGLIDWWYGYGRKKRRQRR | SEQ ID NO: 259 |
| CGLFGAIEGFIENGWKGLIDAWYGYGRKKRRQRR | SEQ ID NO: 260 |
| CGLFGAIAGFIENGWKGLIDWWYGYGRKKRRQRR | SEQ ID NO: 261 |
| GLFEAIEGFIENGWKGLIDWWYGYGRKKRRQRRC | SEQ ID NO: 262 |

TABLE 3-continued

Peptide Sequence Listing and ID

| Sequence | SEQ ID |
|---|---|
| YGRKKRRQRRGLFEAIEGFIENGWKGLIDAWYGC | SEQ ID NO: 263 |
| YGRKKRRQRRGLFEAIEGFIENGWKGLIDWWYGC | SEQ ID NO: 264 |
| CGLFHAIHGFIENGWHGLIDWWYGYGRKKRRQRR | SEQ ID NO: 265 |
| CGLFEAIEGFIENGWKGLIDWWYGYGRKKRRQRRK(stearyl) | SEQ ID NO: 266 |
| CGLFKALLKLLKSLWKLLLKAWYGYGHKKHHQHR | SEQ ID NO: 267 |
| CGLFKALLKLLKSLWKGLLKAWYGYGHKKHHQHR | SEQ ID NO: 268 |
| CGLAKALLKLLKSLWKGLIEAWYGYGRKKRRQRR | SEQ ID NO: 269 |
| CGIFGAIAGFIKNIW | SEQ ID NO: 270 |
| CIFGAIAGFIKNIWEGLIDGWYGYGRKKRRQRR | SEQ ID NO: 271 |
| CGIFGAIAGFIKNIWEGLIDGYGRKKRRQRR | SEQ ID NO: 272 |
| CGIFGAIAGFIKNIWKGLIDAWYGYGRKKRRQRR | SEQ ID NO: 273 |
| CIFGAIAGFIKNIWKGLIDWWYGYGRKKRRQRR | SEQ ID NO: 274 |
| CLFGAIAGFIKNIW | SEQ ID NO: 275 |
| CGL(R5)EAIEGF(S8)ENGWEGMIDGWYGYGRKKRRQRR | SEQ ID NO: 276 |
| CGLFEA(S5)EGF(S5)ENGWEGMIDGWYGYGRKKRRQRR | SEQ ID NO: 277 |
| CGLFEAIEGFIENGWEGAIDGWYGYGRKKRRQRR | SEQ ID NO: 278 |
| CGLFEAIEGFIENGWEGEIDGWYGYGRKKRRQRR | SEQ ID NO: 279 |
| CGIFGAIAGFIKNGWEGMVDWYGYGRKKRRQRR | SEQ ID NO: 280 |
| CGLFEAIAGFIENGWEGMIDGWYGFYGRKKRRQRR | SEQ ID NO: 281 |
| CGIFGAIAGFIKNGWEGMIDGWYGYGRKKRRQRR | SEQ ID NO: 282 |
| CIFGAIAGFIKNIW | SEQ ID NO: 283 |
| CIFGAIAGFIKNIWYGRKKRRQRR | SEQ ID NO: 284 |
| CGIFGAIAGFIKNIWEGMIDGWYGYGRKKRRQRR | SEQ ID NO: 285 |
| CGLFEAIEGFIENGWEGLIEAYGRKKRRQRR | SEQ ID NO: 286 |
| CGLFEALLGFIENGWEGLIDGYGRKKRRQRR | SEQ ID NO: 287 |
| CGLFGAIEGFIENGWEGLIDGWYGYGRKKRRQRRR | SEQ ID NO: 288 |
| CELFGAIEGFIENGWEGMIDGWYGYGRKKRRQRRR | SEQ ID NO: 289 |
| CGLFEAIEGFIENGWEGMIDGWYGYGHKKHHQHR | SEQ ID NO: 290 |
| CGLFGAIEGFIEGGWPGLINGWYGYGRKKRRQRRR | SEQ ID NO: 291 |
| CGLFKALLKLLKSLWKLLLKAYGRKKRRQRR | SEQ ID NO: 292 |
| CGLFKALLKLLKSLWKLLLKAWYGRKKRRQRR | SEQ ID NO: 293 |
| CGLFRALLRLLRSLWRLLLRAYGRKKRRQRR | SEQ ID NO: 294 |
| CGLFEAILGFIENGWEGLIDGWYGYGRKKRRQRR | SEQ ID NO: 295 |
| CGLFEAIWEFIENGWEGLIDGWYGYGRKKRRQRR | SEQ ID NO: 296 |
| CGLFEAIEGFIENGWEGMIDGWYGGGGLHLLHHLLHHLHHLLHHLLHL | SEQ ID NO: 297 |
| CGPVEDAITAAIGRVADTVGTYGRKKRRQRR | SEQ ID NO: 298 |
| CMDGTLFPGDDDLAIPATEFFSTKA | SEQ ID NO: 299 |
| CGLFEALEEFIEGGWEGLLEAWYGYGRKKRRQRR | SEQ ID NO: 300 |

TABLE 3-continued

Peptide Sequence Listing and ID

| Sequence | SEQ ID |
|---|---|
| CGLFEALEEFIENGWEGLLEAWYGYGRKKRRQRR | SEQ ID NO: 301 |
| CELFGAIWEFIEGGWEGLIEAYGRKKRRQRR | SEQ ID NO: 302 |
| CGLFEAIEGFIEEGWEGMIDGWYGYGRKKRRQRR | SEQ ID NO: 303 |
| CGLFEAIAEFIENGWEGMIDGWYGYGRKKRRQRR | SEQ ID NO: 304 |
| CGLFEAIAEFIEGLWEGLIEGWYGYGRKKRRQRR | SEQ ID NO: 305 |
| CGLLEALEGLLESLWEGLLEAWYGYGRKKRRQRR | SEQ ID NO: 306 |
| CGLFEAIEGFIENGWEGMIDIWYGYGRKKRRQRR | SEQ ID NO: 307 |
| CGLFEAIEGFIENGWRGMIDGWYGYGRKKRRQRR | SEQ ID NO: 308 |
| CGLFEAIEGFIENGWDGMIDGWYGYGRKKRRQRR | SEQ ID NO: 309 |
| CGLFEAIEGFIENHWEGMIDGWYGYGRKKRRQRR | SEQ ID NO: 310 |
| CGLFEAIEGFIENWWKGLIDWWYGYGRKKRRQRR | SEQ ID NO: 311 |
| GLFEAIEGFIENGWKGLIDAWYGYGRKKRRQRRC | SEQ ID NO: 312 |
| CGLFEAIEGFIENGWKGMIDAWYGYGRKKRRQRR | SEQ ID NO: 313 |
| CGLFEAIEGFIENGWKGMIDWWYGYGRKKRRQRR | SEQ ID NO: 314 |
| CGLAEAIEGFIENGLKGLIDWWYGYGRKKRRQRR | SEQ ID NO: 315 |
| RRQRRKKRGYGYWGDILGEWGNEIFGEIAEFLGC all(D) | SEQ ID NO: 316 |
| CRRQRRKKRGYGYWGDILGEWGNEIFGEIAEFLG all(D) | SEQ ID NO: 317 |
| CGLFEAIEGFIENGWKGLIDWWYGYGRKKRRQRR | SEQ ID NO: 318 |
| CGFFEAIEGFIENGLKGLIDAWYGYGRKKRRQRR | SEQ ID NO: 319 |
| CGLFEAIEGFIENGLKGLIDAWYGYGRKKRRQRR | SEQ ID NO: 320 |
| CELFGAIEGFIENGWKGLIDAWYGYGRKKRRQRR | SEQ ID NO: 321 |
| CGLFKAIKGFIKNGWKGLIKAWYGYGRKKRRQRR | SEQ ID NO: 322 |
| CGLAEALLELLESLWKGLIEAYGRKKRRQRR | SEQ ID NO: 323 |
| CGIFGAIEGFIENGWKGLIDAWYGYGRKKRRQRR | SEQ ID NO: 324 |
| CGIAGAIAGFIKNIWEGLIDWWYGYGRKKRRQRR | SEQ ID NO: 325 |
| CGIAGAIAGFIKNIWKGLIDAWYGYGRKKRRQRR | SEQ ID NO: 326 |
| CGIFGAIAGFIKNIWEGLIDGWYGKKKKKKKKK | SEQ ID NO: 327 |
| CG(R5)FEAIEG(S8)IENGWEGMIDGWYGYGRKKRRQRR | SEQ ID NO: 328 |
| CGLFEAIEGF(R5)ENGWEG(S8)IDGWYGYGRKKRRQRR | SEQ ID NO: 329 |
| GLFEAIEGFIENGWEGMIDGWYGCYGRKKRRQRR | SEQ ID NO: 330 |
| GLFEAIEGFIENGWEGMIDGWYGGCYGRKKRRQRR | SEQ ID NO: 331 |
| GLLEALEGLLENGWEGLLDGWYGYGRKKRRQRR | SEQ ID NO: 332 |
| CFFGAIWEFIRNIL | SEQ ID NO: 333 |
| CIFGAIAGFIRSIL | SEQ ID NO: 334 |
| CGLFEEIEEFIENGWEGLIDWWYGYGRKKRRQRR | SEQ ID NO: 335 |
| CGFFGAIWEFIKSIL | SEQ ID NO: 336 |
| GFFGAIWEFIKSILC | SEQ ID NO: 337 |
| CGLFEALEGFIENGWEGLLDGWYGYGROORRQRR (O = ornithine) | SEQ ID NO: 338 |

TABLE 3-continued

Peptide Sequence Listing and ID

| Sequence | SEQ ID |
|---|---|
| CGLFEALLELLENGWELLLEAWYGYGRKKRRQRR | SEQ ID NO: 339 |
| CGLFEALLELLENGWELLLDGWYGYGRKKRRQRR | SEQ ID NO: 340 |
| CALFEAIEAFIENGWEAMIDAWYGYGRKKRRQRR | SEQ ID NO: 341 |
| CGLFGAIWGFIENGWEGLIDGWYGYGRKKRRQRR | SEQ ID NO: 342 |
| CGLFEAIEELIENLWKGLIDWWYGYGRKKRRQRR | SEQ ID NO: 343 |
| CGLFEEIEGFIENGWKGLIDWWYGYGRKKRRQRR | SEQ ID NO: 344 |
| CGLFEEIEGFIENGWKGLIDWWYGYGHKKHHQHR | SEQ ID NO: 345 |
| CFFGAIWEFIKNILKGLIDGWYG | SEQ ID NO: 346 |
| CGIFGAIAGFIRSIL | SEQ ID NO: 347 |
| CGLFEEIEGFIENGWEGMIDGWYGYGRKKRRQRR | SEQ ID NO: 348 |
| CGLFEAIEGFIENGWEGMIDGWNGYGRKKRRQRR | SEQ ID NO: 349 |
| AGYLLGKINLKALAALAKKILHHHHHHKKKKKKC | SEQ ID NO: 350 |
| Bis CGLFEAIEGFIENGWEGMIDWWYGYGRKKRRQRR | SEQ ID NO: 351 |
| CGLFEAIEGFIENGWEGMIDGWYG-(PEG)6-YGRKKRRQRR | SEQ ID NO: 352 |
| CGIFGAIWNGIKSLFEGLIDWYGYGRKKRRQRR | SEQ ID NO: 353 |
| CGIFGAIEGFIENGWEGLIDWWYGYGRKKRRQRR | SEQ ID NO: 354 |
| CIFGAIAGFIKNIWEGLIDWWYGYGRKKRRQRR | SEQ ID NO: 355 |
| CGLFEAIEGFIENGWKGLIDGWYGGLFEAIEGFIENGWKGLIDWWYG | SEQ ID NO: 356 |
| CWEAALAEALAEALAEHLAEALAEALEALAAYGRKKRRQRRK(stearyl) | SEQ ID NO: 357 |
| CGLFEAIEGFIENGWKGLIDWWYGYGRKKRRQRR | SEQ ID NO: 358 |
| CGLFEELEELLEEGWEGLLEAYGRKKRRQRR | SEQ ID NO: 359 |
| CGNFEEIEEFIEEGLRNFIDWWYGYGHKKHHQHR | SEQ ID NO: 360 |
| CFFGAIWEFIRNILEGLIDWWYGYGRKKRRQRR | SEQ ID NO: 361 |
| CFFGAIWEFIKNILLHLLHHLHHLLHHLLHHLLHL | SEQ ID NO: 362 |
| CGLFEAIEGFIENGWEGMIDGWYGYGRKKRRQRR all(D) | SEQ ID NO: 363 |
| CGFFHAFFHFFHSFWHGFFEA | SEQ ID NO: 364 |
| CGLFHALLHLLHSLWHGLLHWWYGYGHKKHHQHR | SEQ ID NO: 365 |
| CGLFGALLELLESLWEGLLEWYGRKKRRQRR | SEQ ID NO: 366 |
| CGLFGALLELLESLWEGLLEWYGHKKHHQHR | SEQ ID NO: 367 |
| CGLFHALLHLLHSLWKGLLEWWYGF | SEQ ID NO: 368 |
| CIFGAIAGFIRSILEGF | SEQ ID NO: 369 |
| CGIFGAIAGFIKNIWKGLIDA | SEQ ID NO: 370 |
| CFFEAIEEFIKNIWK | SEQ ID NO: 371 |
| CGLFEAIEGFIENGWKGLIDWLAEALAEALEALAA | SEQ ID NO: 372 |
| GCGIFGAIAEFIKNIW | SEQ ID NO: 373 |
| CIFGAIAEFIKNIWKGLIDW | SEQ ID NO: 374 |
| CFFGAIWEFIKSILELLLEAYGHKKHHQHRR | SEQ ID NO: 375 |
| CWFGAIWEFIKSIL | SEQ ID NO: 376 |

TABLE 3-continued

Peptide Sequence Listing and ID

| Sequence | SEQ ID |
|---|---|
| CAFGAIWEFIKSIL | SEQ ID NO: 377 |
| CFLGAIWEFIKSIL | SEQ ID NO: 378 |
| CFFGAIWEFIKSIK | SEQ ID NO: 379 |
| CGFIGAIANLLSKIFEGLIDGWYGYGRKKRRQRR all(D) | SEQ ID NO: 380 |
| CFFGAIWEFIKSIL | SEQ ID NO: 381 |
| CIFGAIAGFIKNIWLHLLHHLLHHLHHLLHHLLHL all(D) | SEQ ID NO: 382 |
| CFFGAIAEFIKNIW | SEQ ID NO: 383 |
| CIFEAIWGFIKNIW | SEQ ID NO: 384 |
| stearyl-AGYLLGKINLKALAALAKKILHHHHHHKKKKKC | SEQ ID NO: 385 |
| CIFEAIAGFIKNIWKGLIDWWYGYGRKKRRQRR | SEQ ID NO: 386 |
| CGLFEAIEGFIENGWKGLIDWWYGGRPRESGKKRKRKRLKP | SEQ ID NO: 387 |
| C(b-Ala)GFGEIEEFIENGLKNLIDWWYGYGHKKHHQHR | SEQ ID NO: 388 |
| C(b-Ala)GPEFIEEFIENGLKNLIDWWYGYGRKKRRQRR | SEQ ID NO: 389 |
| C(b-Ala)GPEFIEEFIENGLKNLIDWWYGYGHKKHHQHR | SEQ ID NO: 390 |
| CGGIEEIAGLLSKILKGLIDWWYGYGHKKHHQHR | SEQ ID NO: 391 |
| CGFIGAIANLLSKIFEGLIDWWYGYGRKKRRQRR | SEQ ID NO: 392 |
| CGFIGAIAELLEKIFEGLIDWWYGYGRKKRRQRR | SEQ ID NO: 393 |
| CGFIGAIAELLEKIFEGLIDWWYGYGHKKHHQHR | SEQ ID NO: 394 |
| CFFGAIWEFIRNILEGLIDWWYGYGHKKHHQHR | SEQ ID NO: 395 |
| CFFGAIWEFIKSILLHLLHHLLHHLHHLLHHLLHL | SEQ ID NO: 396 |
| CFFGAIWEFIRSILLHLLHHLLHHLHHLLHHLLHL | SEQ ID NO: 397 |
| CGFFGAIWEFIRSILEGFIDWWYGYGYGHKKHHQHR | SEQ ID NO: 398 |
| CGLFEAIWEFIKSILEGLLEAYGHKKHHQHR | SEQ ID NO: 399 |
| CGLFEAIWEFIKSILEGLLEAWYGYGHKKHHQHR | SEQ ID NO: 400 |
| CGIFGAIAGFIKNIWKYGRKKRRQRR | SEQ ID NO: 401 |
| CGLFEALLELLESLWELLLEAWYGYGHKKHHQHR | SEQ ID NO: 402 |
| CIFGAIAGFIRNIWKGLIDGWYG | SEQ ID NO: 403 |
| CGIFGAIAGFIRNIWKGLIDGWYG | SEQ ID NO: 404 |
| CFFGAIWEFIKNILKLHLLHHLLHHLHHLLHHLLHL | SEQ ID NO: 405 |
| CFFGAIWEFIRNILLHLLHHLLHHLHHLLHHLLHL | SEQ ID NO: 406 |
| CFFGKIWEFIKSIL | SEQ ID NO: 407 |
| CYGRKKRRQRRGLFEALLELLESLWELLLEA | SEQ ID NO: 408 |
| FFGAIWEFIKSILC | SEQ ID NO: 409 |
| CWWGAIEGFIKSIL | SEQ ID NO: 410 |
| CFFGAIWEWIKSIL | SEQ ID NO: 411 |
| CFFGAIWEFWKSIL | SEQ ID NO: 412 |
| CFFGAIWEFIKFIL | SEQ ID NO: 413 |
| CFFGAIWEFIKKIL | SEQ ID NO: 414 |

TABLE 3-continued

Peptide Sequence Listing and ID

| Sequence | SEQ ID |
|---|---|
| CFFGAIWEFIKGIL | SEQ ID NO: 415 |
| CFFGAIWEFIKLIL | SEQ ID NO: 416 |
| CFFGAIWEFIKWIL | SEQ ID NO: 417 |
| CFFGAIWEFIKSFL | SEQ ID NO: 418 |
| CFFGAIWEFIKSKL | SEQ ID NO: 419 |
| CFFGFIWEFIKSIL | SEQ ID NO: 420 |
| CIFGAIAGFIKNILKGLIDAF | SEQ ID NO: 421 |
| CFFGKIWELWEWIL | SEQ ID NO: 422 |
| CFFGAIWEFAKSIL | SEQ ID NO: 423 |
| CFFGAIWEFIKSAL | SEQ ID NO: 424 |
| CFFGAIWEFIKSWL | SEQ ID NO: 425 |
| CFFGAIWEFIKSILK | SEQ ID NO: 426 |
| CFFGAIWEFIKSILE | SEQ ID NO: 427 |
| CFFKAIWEFIKSIL | SEQ ID NO: 428 |
| CFFNAIWEFIKSIL | SEQ ID NO: 429 |
| CFFGGIWEFIKSIL | SEQ ID NO: 430 |
| CFFGNIWEFIKSIL | SEQ ID NO: 431 |
| CFFGALWEFIKSIL | SEQ ID NO: 432 |
| CFFGAAWEFIKSIL | SEQ ID NO: 433 |
| CGLFHALLHLLHSLWHGLLDG | SEQ ID NO: 434 |
| CGLFHALLHLLHSLWHGLLEW | SEQ ID NO: 435 |
| CGLFHALLHLLHSLWHLLLEA | SEQ ID NO: 436 |
| CGLFHALLHLLHSLWKLLLEW | SEQ ID NO: 437 |
| CKFGAIWEFIKSIL | SEQ ID NO: 438 |
| CFKGAIWEFIKSIL | SEQ ID NO: 439 |
| CFFGAIWKFIKSIL | SEQ ID NO: 440 |
| CFFGAIWAFIKSIL | SEQ ID NO: 441 |
| CFFGAIWLFIKSIL | SEQ ID NO: 442 |
| CFFGAIWFFIKSIL | SEQ ID NO: 443 |
| CFFGAIWNFIKSIL | SEQ ID NO: 444 |
| CFFGAIWELIKSIL | SEQ ID NO: 445 |
| CFFGAIWEAIKSIL | SEQ ID NO: 446 |
| CGLFEAIEGFIENGWEGLAEALAEALEALAAYGRKKRRQRR | SEQ ID NO: 447 |
| CIFGAIAGFIKNIWEGMIDGWYGYGRKKRRQRR | SEQ ID NO: 448 |
| CIFGAIAGFIKNIWEGLIDAWYGYGRKKRRQRR | SEQ ID NO: 449 |
| CIFGAIAGFIKNIWKGLIDAWYGYGRKKRRQRR | SEQ ID NO: 450 |
| CIFGAIAGFIKNIWIFGAIAGFIKNIWWYGYGRKKRRQRR | SEQ ID NO: 451 |
| CGLFGAIAGFIENGWEGLIEGWYG | SEQ ID NO: 452 |

TABLE 3-continued

Peptide Sequence Listing and ID

| Sequence | SEQ ID |
|---|---|
| CGLFEAIEGFIENGWEGLIDGWYGYGOOOOOQRR (O = ornithine) | SEQ ID NO: 453 |
| CGLFEAIEGFIENGWKGLIDWWYGYGRKKRRQRR | SEQ ID NO: 454 |
| CGLFEAIEGFIENGWEGLIDGWYGYGRKKRRQRRK(stearyl) | SEQ ID NO: 455 |
| CYGHKKHHQHRGLFEAIEGFIENGWKGLIDWWYG | SEQ ID NO: 456 |
| CYGHKKHHQHRGLFEAIEEFIENGWEGLIDGWYG | SEQ ID NO: 457 |
| CGLFEAIEGFIENGWKGLIDGWYGYGRKKRRQRRK(stearyl) | SEQ ID NO: 458 |
| CGLFEAIEGFIENGWHGMIDGWYGYGRKKRRQRR | SEQ ID NO: 459 |
| IFGIDDLIIGLLFVAIVEAGIGGYLLGSYGRKKRRQRRC | SEQ ID NO: 460 |
| CGFFGEIAELIEEGLKGLIDWWNG | SEQ ID NO: 461 |
| CGLFGEIEELIEEGLENLIDWWNG | SEQ ID NO: 462 |
| CFFGAIWEFIHSIL all (D) | SEQ ID NO: 463 |
| CFFGAIWEFIHNIL | SEQ ID NO: 464 |
| CFFGAIWEFIHSIFK | SEQ ID NO: 465 |
| CGIFEAIAGLLKWIFK | SEQ ID NO: 466 |
| CGIFELIAGLLKNIFK | SEQ ID NO: 467 |
| CGIFEAIAGLLKSILKK(stearyl) | SEQ ID NO: 468 |
| CGIFGAIAGLLKSILKK(stearyl) | SEQ ID NO: 469 |
| CIFGAIAGFIKNILKGL all (D) | SEQ ID NO: 470 |
| CIFGAIAGFIKNILKGLIDGWWYG | SEQ ID NO: 471 |
| CIFGAIAGFIKNIWHGLI | SEQ ID NO: 472 |
| CIFGAIAGFIKNILKGLK(stearyl) | SEQ ID NO: 473 |
| GLGKLINKIFGAIAGFIC all (D) | SEQ ID NO: 474 |
| CGIFEAIAGLLKNIFD | SEQ ID NO: 475 |
| CGIFEAIAGLLKNIFE | SEQ ID NO: 476 |
| CGIFEAIAGLLKNIFR | SEQ ID NO: 477 |
| CGIFEAIAGLLKNIFH | SEQ ID NO: 478 |
| CGIFEAIAGLLKNIFO (O = ORNITHINE) | SEQ ID NO: 479 |
| CGIFEAIAGLLKNIFN | SEQ ID NO: 480 |
| CGIFEAIAGLLKNIFCit (Cit = citrulline) | SEQ ID NO: 481 |
| CGIFEAIWGLLKNIFK | SEQ ID NO: 482 |
| CGIFGAIWGLLKNIFK | SEQ ID NO: 483 |
| CIFGAIAGLLKNIFK | SEQ ID NO: 484 |
| CIFEAIAGLLKNIFK | SEQ ID NO: 485 |
| CFFGAIAGLLKNIFK | SEQ ID NO: 486 |
| CFFEAIAGLLKNIFK | SEQ ID NO: 487 |
| CGFFEAIAGLLKNIFK | SEQ ID NO: 488 |
| CIFGAIAGFIKNIWEGLI all (D) | SEQ ID NO: 489 |
| CIFGAIAGLLKNIFK all(D) | SEQ ID NO: 490 |

TABLE 3-continued

Peptide Sequence Listing and ID

| Sequence | SEQ ID |
|---|---|
| CGLFGEIEELIEEGLENLIDWWNG all(D) | SEQ ID NO: 491 |
| CGNFGEIEELIEEGLENLIDWWNG all(D) | SEQ ID NO: 492 |
| CGFFGEIAELIEEGLKGLIDWWNG all(D) | SEQ ID NO: 493 |
| CGLFGEIEELIEEGLENLIDWWNE | SEQ ID NO: 494 |
| CGFFGAIAGLLKNIFK | SEQ ID NO: 495 |
| CGLFELIEGFIENGWEGMIDGWYGYGRKKRRQRRK(stearyl) | SEQ ID NO: 496 |
| CGLFELIEGFIEWGWEGMIDGWYGYGRKKRRQRRK(stearyl) | SEQ ID NO: 497 |
| CGLFEAIEGFIENGWEGMIDGWYGYGRKKRRQRRK(2H,2H,3H,3H-perfluorononanoyl) | SEQ ID NO: 498 |
| CGLFEAIEGFIENGWEGMIDGWYGYGRKKRRQRRK(2H,2H,3H,3H-perfluoro-10 methylundecanoyl) | SEQ ID NO: 499 |
| CIFGAIAGFIKNIWEGLIK(2H,2H,3H,3H-perfluorononanoyl) | SEQ ID NO: 500 |
| CIFGAIAGFIKNIWEGLIK(2H,2H,3H,3H-perfluoro-10 methylundecanoyl) | SEQ ID NO: 501 |
| CGLFEAIEGFIEWGWEGMIDGWYGYGRKKRRQRRK(2H,2H,3H,3H-perfluorononanoyl) | SEQ ID NO: 502 |
| CGLFEAIEGFIEWGWEGMIDGWYGYGRKKRRQRRK(2H,2H,3H,3H-perfluoro-10 methylundecanoyl) | SEQ ID NO: 503 |
| CGLFELIEGFIENGWEGMIDGWYGYGRKKRRQRRK(2H,2H,3H,3H-perfluorononanoyl) | SEQ ID NO: 504 |
| CGLFELIEGFIENGWEGMIDGWYGYGRKKRRQRRK(2H,2H,3H,3H-perfluoro-10 methylundecanoyl) | SEQ ID NO: 505 |
| CFFGAIWEFIHSILK(2H,2H,3H,3H-perfluorononanoyl) | SEQ ID NO: 506 |
| CFFGAIWEFIHSILK(2H,2H,3H,3H-perfluoro-10 methylundecanoyl) | SEQ ID NO: 507 |
| CIFGAIAGFIKNILKGLK(2H,2H,3H,3H-perfluorononanoyl) | SEQ ID NO: 508 |
| CIFGAIAGFIKNILKGLK(2H,2H,3H,3H-perfluoro-10 methylundecanoyl) | SEQ ID NO: 509 |
| CFFGAIWEFIRNILEGFK(2H,2H,3H,3H-perfluorononanoyl) | SEQ ID NO: 510 |
| CFFGAIWEFIRNILEGFK(2H,2H,3H,3H-perfluoro-10 methylundecanoyl) | SEQ ID NO: 511 |
| CGLFGEIEELIEEGLENLIDWWNQ | SEQ ID NO: 512 |
| CGIFGAIAGLLKSALK | SEQ ID NO: 513 |
| CGIFEAIAGLLKSIWK | SEQ ID NO: 514 |
| CGIFEAIAGLLKSILK | SEQ ID NO: 515 |
| CGIFEAIAGLLONIFK (O = Ornithine) | SEQ ID NO: 516 |
| CGIFEAIAGLLKNILKGLIDGWYG | SEQ ID NO: 517 |
| CGIFGAIAGLLKNILKGLIDGWYG | SEQ ID NO: 518 |
| CGIFGAIAGLLKNIFKGLIDGWYG | SEQ ID NO: 519 |
| CGIFGAIWELWEWILK | SEQ ID NO: 520 |
| CGIFEAIWELWEWILK | SEQ ID NO: 521 |
| CGLFEAIEGFIENGWEGMIDGWYGK(stearyl) | SEQ ID NO: 522 |
| (stearyl)GLFEAIEGFIENGWEGMIDGWYGC | SEQ ID NO: 523 |
| CFLE-Aib-LWKLLEHLL | SEQ ID NO: 524 |
| CFLE-Aib-LWELLEHLL | SEQ ID NO: 525 |

TABLE 3-continued

Peptide Sequence Listing and ID

| Sequence | SEQ ID |
|---|---|
| CFLEALWE-Aib-LEHLL | SEQ ID NO: 526 |
| CFLE-Aib-LWE-Aib-LEHLL | SEQ ID NO: 527 |
| CFLE-Aib-LWEALEKLF | SEQ ID NO: 528 |
| (stearyl)IFGAIAGFIKNIWEGLIC | SEQ ID NO: 529 |
| CIFGAIAGFIKNIWEGLIK(stearyl) | SEQ ID NO: 530 |
| (stearyl)FFGAIWEFIKSILC | SEQ ID NO: 531 |
| CFFGAIWEFIKSILK(stearyl) | SEQ ID NO: 532 |
| (stearyl)FFGAIWEFIHSILC | SEQ ID NO: 533 |
| CFFGAIWEFIHSILK(stearyl) | SEQ ID NO: 534 |
| (stearyl)GIFEAIAGLLKNIFKC | SEQ ID NO: 535 |
| CGIFEAIAGLLKNIFK(stearyl) | SEQ ID NO: 536 |
| CGIFEAIAGLLKNIFKK(stearyl) | SEQ ID NO: 537 |
| (stearyl)IFGAIAGFIKNILKGLC | SEQ ID NO: 538 |
| CIFGAIAGFIKNILKGLK(stearyl) | SEQ ID NO: 539 |
| CIFGAIAGFIKNILKGL | SEQ ID NO: 540 |
| CGLFGEIEELIEEGLENLIDWWNS | SEQ ID NO: 541 |
| CGLFEAIEGFIENGWEGMIDGWYGYGRKKRRQRR | SEQ ID NO: 542 |
| CGFFGEIAELIEEGLKNLIDWWNG | SEQ ID NO: 543 |
| CGLFEAIEGFIENGWKGMIDGWYGYGRKKRRQRR | SEQ ID NO: 544 |
| CGLFEAIEGFIEWGWEGMIDGWYGYGRKKRRQRR | SEQ ID NO: 545 |
| CGLFELIEGFIENGWEGMIDGWYGYGRKKRRQRR | SEQ ID NO: 546 |
| CIFGAIAGFIKNIWEGLI | SEQ ID NO: 547 |
| CGLFGEIEELIEEGLENLIDWWNG | SEQ ID NO: 548 |
| CGLFEEIEGFIENGWEGLIDWWYGYGHKKGGQHR | SEQ ID NO: 549 |
| CGLFEAIEGFIENGWEGMIDGWYGYGRKKRRQRRK(stearyl) | SEQ ID NO: 550 |
| CGLFEALLELLESLWELLEAYGRKKRRQRR | SEQ ID NO: 551 |
| CGLFEALLELLESLWELLEAYGRKKRRQRR | SEQ ID NO: 552 |
| CFFGAIWEFIRNILEGF | SEQ ID NO: 553 |
| CFFGAIWEFIRNILEGFK(stearyl) | SEQ ID NO: 554 |
| CIFGAIAGFIKNIWEGLIK(lauryl) | SEQ ID NO: 555 |
| (lauryl)FFGAIWEFIKSILC | SEQ ID NO: 556 |
| CFFGAIWEFIKSILK(lauryl) | SEQ ID NO: 557 |
| (lauryl)FFGAIWEFIHSILC | SEQ ID NO: 558 |
| CFFGAIWEFIHSILK(lauryl) | SEQ ID NO: 559 |
| (lauryl)GIFEAIAGLLKNIFKC | SEQ ID NO: 560 |
| CGIFEAIAGLLKNIFK(lauryl) | SEQ ID NO: 561 |
| CFFGAIWEFIRNILEGFK(lauryl) | SEQ ID NO: 562 |
| (lauryl)GLFEAIEGFIENGWEGMIDGWYGC | SEQ ID NO: 563 |

TABLE 3-continued

Peptide Sequence Listing and ID

| Sequence | SEQ ID |
|---|---|
| CGLFEAIEGFIENGWEGMIDGWYGK(lauryl) | SEQ ID NO: 564 |
| CGKFTIVFPHNQKGNWKNVPSNYHYK(stearyl) | SEQ ID NO: 565 |
| CMDGTLFPGDDDLAIPATEFFSTKAK(stearyl) | SEQ ID NO: 566 |
| CNPVENYIDEVLNEVLVVPNINSSNK(stearyl) | SEQ ID NO: 567 |
| CVTPHHVLVDEYTGEWVDSQFK(stearyl) | SEQ ID NO: 568 |
| CIFGIDDLIIGLLFVAIVEAGIGGYLLGSK(stearyl) | SEQ ID NO: 569 |
| CGAAIGLAWIPYFGPAAEK(stearyl) | SEQ ID NO: 570 |
| CFAGVVLAGAALGVATAAQITAGIALHK(stearyl) | SEQ ID NO: 571 |
| CFLGFLLGVGSAIASGIAVSKVLHLK(stearyl) | SEQ ID NO: 572 |
| CFFGAVIGTIALGVATSAQITAGIALAK(stearyl) | SEQ ID NO: 573 |
| CFFGAVIGTIALGVATAAQITAGIALAK(stearyl) | SEQ ID NO: 574 |
| GLFEAIAGFIENGGWEGMIDGGGK(stearyl) | SEQ ID NO: 575 |
| GLFKAIAKFIKGGWKGLIKGWYGK(stearyl) | SEQ ID NO: 576 |
| GLFHAIAHFIHGGWHGLIHGWYGK(stearyl) | SEQ ID NO: 577 |
| CGLFEAIAEFIENGWEGLIEGWYGK(stearyl) | SEQ ID NO: 578 |
| CGFFGAIAGFLEGGWEGMIAGWHGK(stearyl) | SEQ ID NO: 579 |
| CFAGVVIGLAALGVATAAQVTAAVALVKK(stearyl) | SEQ ID NO: 580 |
| CAVGIVGAMFLGFLGAAGSTMGAVSLTLTVQAK(stearyl) | SEQ ID NO: 581 |
| CGVFVLGFLGFLATAGSAMGARSLTLSAK(stearyl) | SEQ ID NO: 582 |
| CVPFVLGFLGFLGAAGTAMGAAATALTVK(stearyl) | SEQ ID NO: 583 |
| CAVPVAVWLVSALAMGAGVAGGITGSMSLASGK(stearyl) | SEQ ID NO: 584 |
| CGLASTLTRWAHYNALIRAFK(stearyl) | SEQ ID NO: 585 |
| CGPVEDAITAAIGRVADTVGTK(stearyl) | SEQ ID NO: 586 |
| CGLGQMLESMIDNTVREVGGAK(stearyl) | SEQ ID NO: 587 |
| CGLFEAIEGFIENGWEGMIDGWYGFK(stearyl) | SEQ ID NO: 588 |
| (D)-(cgl)FEAIEGFIENGWEGMIDGWYGYGRKKRR(D)-(qrr) | SEQ ID NO: 589 |
| CG(lf)LEAIEGFIENGWEGMIDGWYGYGRKKRRQRR | SEQ ID NO: 590 |
| CIFGIDDLIIGLLFVAIVEAGIGGYLLGS(stearyl) | SEQ ID NO: 591 |
| CVTVLALGALAGVGVG(stearyl) | SEQ ID NO: 592 |
| CLLGRRGWEVLKYWWNLLQYWSQEL(stearyl) | SEQ ID NO: 593 |
| CGIFEAIAGLLKNIFD | SEQ ID NO: 594 |
| CGIFEAIAGLLKNIFE | SEQ ID NO: 595 |
| CGIFEAIAGLLKNIFR | SEQ ID NO: 596 |
| CGIFEAIAGLLKNIFH | SEQ ID NO: 597 |
| CGIFEAIAGLLKNIFO (O = ORNITHINE) | SEQ ID NO: 598 |
| CGIFEAIAGLLKNIFN | SEQ ID NO: 599 |
| CGIFEAIAGLLKNIFCit (Cit = citrulline) | SEQ ID NO: 600 |
| CGIFGAIWGLLKNIFK | SEQ ID NO: 601 |

TABLE 3-continued

Peptide Sequence Listing and ID

| Sequence | SEQ ID |
|---|---|
| CIFEAIAGLLKNIFK | SEQ ID NO: 602 |
| CFFEAIAGLLKNIFK | SEQ ID NO: 603 |
| CGFFEAIAGLLKNIFK | SEQ ID NO: 604 |
| CGIFEAIAGLLKNIFKG | SEQ ID NO: 605 |
| CGIFEAIAGLLKNIFKGL | SEQ ID NO: 606 |
| CGIFEAIAGLLKNIFKGLI | SEQ ID NO: 607 |
| CGIFEAIAGLLKNIFKGLID | SEQ ID NO: 608 |
| CGIFEAIAGLLKNIFKGLIDG | SEQ ID NO: 609 |
| CGIFEAIAGLLKNIFKGLIDGF | SEQ ID NO: 610 |
| CGIFEAIAGLLKNIFKGLIDGWYG | SEQ ID NO: 611 |
| CGIFEAIAGLLKNIFK | SEQ ID NO: 612 |
| CGIFEAIAGLLKSILK | SEQ ID NO: 613 |
| CGIFEAIAGLLKNIFKA | SEQ ID NO: 614 |
| CGIFEAIAGLLKNIFKL | SEQ ID NO: 615 |
| CGIFEAIAGLLKNIFKW | SEQ ID NO: 616 |
| CGIFEAIAGLLKNIFKF | SEQ ID NO: 617 |
| CGIFEAIAGLLKNAFK | SEQ ID NO: 618 |
| CGIFGAIAGLLKNAFK | SEQ ID NO: 619 |
| CGIFEAIAGLLONIFO (O = Ornithine) | SEQ ID NO: 620 |
| CGIFEAIAGLLKNIFKGIFEAIAGLLKNIFK | SEQ ID NO: 621 |
| CGIFEAIAGLLKNIFKFFGAIWEFIHSIL | SEQ ID NO: 622 |
| CFFGAIWEFIHSILGIFEAIAGLLKNIFK | SEQ ID NO: 623 |
| CFFGAIWEFIHSILFFGAIWEFIHSIL | SEQ ID NO: 624 |
| CFFGAIWEFIHSILGFFGAIWEFIHSIL | SEQ ID NO: 625 |
| CGIFEAIAGLLKNIFKGIFEAIAGLLKNIFK | SEQ ID NO: 626 |
| CGIFEAIAGLLKNIFKFFGAIWEFIHSIL | SEQ ID NO: 627 |
| CFFGAIWEFIHSILGIFEAIAGLLKNIFK | SEQ ID NO: 628 |
| CGLFHALLHLLHSLWHLLLEA | SEQ ID NO: 629 |
| CGLFHALLHLLHSLWHLLLEAK(stearyl) | SEQ ID NO: 630 |
| CGLFHALLHLLHSLWHLLLEAK(stearyl) | SEQ ID NO: 631 |
| (stearyl)GLFHALLHLLHSLWHLLLEAC | SEQ ID NO: 632 |
| CFFGNIWEFIKSIL | SEQ ID NO: 633 |
| CFFGAIWLFIKSIL | SEQ ID NO: 634 |
| CFFGAIWNFIKSIL | SEQ ID NO: 635 |
| CFFGAIWGFIKSIL | SEQ ID NO: 636 |
| CFLGALFKALSKLL | SEQ ID NO: 637 |
| CFLGALFHALSKLL | SEQ ID NO: 638 |
| CFLGALFKALSHLL | SEQ ID NO: 639 |

TABLE 3-continued

Peptide Sequence Listing and ID

| Sequence | SEQ ID |
|---|---|
| CFLGALFHALSHLL | SEQ ID NO: 640 |
| FLGALFKALSKLLC | SEQ ID NO: 641 |
| FLGALFHALSKLLC | SEQ ID NO: 642 |
| FLGALFKALSHLLC | SEQ ID NO: 643 |
| FLGALFHALSHLLC | SEQ ID NO: 644 |
| CFLGALFKALKSLL | SEQ ID NO: 645 |
| CFLGALFHALKSLL | SEQ ID NO: 646 |
| CFLGALFKALHSLL | SEQ ID NO: 647 |
| CFLGALFHALHSLL | SEQ ID NO: 648 |
| FLGALFKALKSLLC | SEQ ID NO: 649 |
| FLGALFHALKSLLC | SEQ ID NO: 650 |
| FLGALFKALHSLLC | SEQ ID NO: 651 |
| FLGALFHALHSLLC | SEQ ID NO: 652 |
| CGIFGAIAGFIKNIWKGLIDW | SEQ ID NO: 653 |
| CGLFEAIEGFIENGWEG-Nle-IDGWYGYGRKKRRQRR | SEQ ID NO: 654 |
| CGLFEAIEGFIENGLKGLIDWWYGYGRKKRRQRR | SEQ ID NO: 655 |
| CGLFEAIEGFIENAWEGMIDGWYGYGRKKRRQRR | SEQ ID NO: 656 |
| CGLFEAIEGFIENGWEGMIDLWYGYGRKKRRQRR | SEQ ID NO: 657 |
| CRLLRLLLRLWRRLLRLLR | SEQ ID NO: 658 |
| CGIFGAIEGFIENGWKGLIDAWYGYRKKRRQRR | SEQ ID NO: 659 |
| CFFGAIWEFAHGIL | SEQ ID NO: 660 |
| CFFGAIWEFARGILEGF | SEQ ID NO: 661 |
| FFGAIWEFAHGILC | SEQ ID NO: 662 |
| FFGAIWEFARGILEGFC | SEQ ID NO: 663 |
| CFFGAIWEFAHSIL | SEQ ID NO: 664 |
| FFGAIWEFAHSILC | SEQ ID NO: 665 |
| CFFGAIWEFARSILK | SEQ ID NO: 666 |
| FFGAIWEFARSILKC | SEQ ID NO: 667 |
| CGIFEAIAGLAKNIFK | SEQ ID NO: 668 |
| GIFEAIAGLAKNIFKC | SEQ ID NO: 669 |
| CGIFEAIAGLAKNIFH | SEQ ID NO: 670 |
| CGIFEAIAGLAHNIFH | SEQ ID NO: 671 |
| CGIFEAIAGLAHNIFK | SEQ ID NO: 672 |
| GIFEAIAGLAKNIFHC | SEQ ID NO: 673 |
| GIFEAIAGLAHNIFHC | SEQ ID NO: 674 |
| CFLGALWKALSKLL | SEQ ID NO: 675 |
| CFLGALWHALSKLL | SEQ ID NO: 676 |
| CFLGALWKALSHLL | SEQ ID NO: 677 |

TABLE 3-continued

Peptide Sequence Listing and ID

| Sequence | SEQ ID |
|---|---|
| CFLGALWHALSHLL | SEQ ID NO: 678 |
| FLGALWKALSKLLC | SEQ ID NO: 679 |
| FLGALWHALSKLLC | SEQ ID NO: 680 |
| FLGALWKALSHLLC | SEQ ID NO: 681 |
| FLGALWHALSHLLC | SEQ ID NO: 682 |
| CGIFGAIAGLLKNAFK | SEQ ID NO: 683 |
| CIFEAIAGLLKNAFK | SEQ ID NO: 684 |
| CIFGAIAGLLKNAFK | SEQ ID NO: 685 |
| CIFEAIWEFIKNIW | SEQ ID NO: 686 |
| CIFEAIAEFIKNIW | SEQ ID NO: 687 |
| CIFGAIWEFIKNIW | SEQ ID NO: 688 |
| CIFGAIAEFIKNIW | SEQ ID NO: 689 |
| CGIFGIAIGFKINIW | SEQ ID NO: 690 |
| CGIFEAIAGLLHNIFK | SEQ ID NO: 691 |
| CGIFEAIWGLLHNIFK | SEQ ID NO: 692 |
| CGFFEAIAGLLHNIFK | SEQ ID NO: 693 |
| CGIFEAIAALLKNIFK | SEQ ID NO: 694 |
| CGIFEAIEGLLKNIFK | SEQ ID NO: 695 |
| CGIFEAIAGFFKNIFK | SEQ ID NO: 696 |
| CGIFEAIAGWWKNIFK | SEQ ID NO: 697 |
| CGIFEAIAGLLKNIWK | SEQ ID NO: 698 |
| CGIFEAIAELLKNIFK | SEQ ID NO: 699 |
| CGIFGAIAGLLKSALK | SEQ ID NO: 700 |
| CGIFEAIAGLLKSIWK | SEQ ID NO: 701 |
| CGIFEAIAGLLKSILK | SEQ ID NO: 702 |
| CGIFEAIAGLLKNIFKGLIDA | SEQ ID NO: 703 |
| CGIFEAIAGLLKNIFKGLIDAF | SEQ ID NO: 704 |
| CGIFEAIAGLLKNIFKGLIDAWYG | SEQ ID NO: 705 |
| CGIFEAIAGLLKNIFKGLIDAWYGF | SEQ ID NO: 706 |
| CGIFEAIAGLLKNIFKGLIDGWYGF | SEQ ID NO: 707 |
| CGIFEAIAGLLKNIFKGLIDW | SEQ ID NO: 708 |
| CGIFEAIAGLLKNIFKGLIDWF | SEQ ID NO: 709 |
| CGIFEAIAGLLKNIFKGLIDWWYG | SEQ ID NO: 710 |
| CGIFEAIAGLLKNIFKGLIDWWYGF | SEQ ID NO: 711 |
| CGIFELIAGLLKNIFK | SEQ ID NO: 712 |
| CGIFEAIAGLLKWIFK | SEQ ID NO: 713 |
| CGIFELIAGLLKWIFK | SEQ ID NO: 714 |
| CGIFELIAGLLKNIFKG | SEQ ID NO: 715 |

TABLE 3-continued

Peptide Sequence Listing and ID

| Sequence | SEQ ID |
|---|---|
| CGIFEAIAGLLKWIFKG | SEQ ID NO: 716 |
| CGIFELIAGLLKWIFKG | SEQ ID NO: 717 |
| CGLFEALLGLLESLWK | SEQ ID NO: 718 |
| CGIFEAIAELLKNIFK | SEQ ID NO: 719 |
| CGIFEALLGLLKSLWK | SEQ ID NO: 720 |
| CGIFEALLELLKSLWK | SEQ ID NO: 721 |
| CGIFEAIAGLLKNIFK | SEQ ID NO: 722 |
| CEIFEAIAGLLKNIFK | SEQ ID NO: 723 |
| CEIFGAIAGLLKNIFK | SEQ ID NO: 724 |
| CGLFEAIAGLLKNLFK | SEQ ID NO: 725 |
| CGIWEAIAGLLKNIWK | SEQ ID NO: 726 |
| CGLFGAIAGLLKNLFK | SEQ ID NO: 727 |
| CGIWGAIAGLLKNIWK | SEQ ID NO: 728 |
| CGIFDAIAGLLKNIFK | SEQ ID NO: 729 |
| CGIFDAIWGLLKNIFK | SEQ ID NO: 730 |
| CGIFGGIGGLLKNIFK | SEQ ID NO: 731 |
| CAIFAAIAALLKNIFK | SEQ ID NO: 732 |
| CGIFEAIAGLLKNIF | SEQ ID NO: 733 |
| CGIFEAIAGLLKNI | SEQ ID NO: 734 |
| CGIFEAIAGLLKN | SEQ ID NO: 735 |
| CGIFEAIAGLLK | SEQ ID NO: 736 |
| CVIFEAIAGLLKNIFK | SEQ ID NO: 737 |
| CSIFEAIAGLLKNIFK | SEQ ID NO: 738 |
| CGIFEEIAGLLKNIFK | SEQ ID NO: 739 |
| CGIFEEIWGLLKNIFK | SEQ ID NO: 740 |
| CGIFEAIEELLKNIFK | SEQ ID NO: 741 |
| CGIFEAIAGLWKNIFK | SEQ ID NO: 742 |
| CGIFEAIAGLLENIFK | SEQ ID NO: 743 |
| CGIFEAIAGLLWNIFK | SEQ ID NO: 744 |
| CGIFEAIAGLLKEIFK | SEQ ID NO: 745 |
| CGIFEAIAGLLKNILK | SEQ ID NO: 746 |
| CGIFEAIAGLLRNIFK | SEQ ID NO: 747 |
| CGIFEAIAGLLKSIFK | SEQ ID NO: 748 |
| CGIFEAIAGLLKNILK | SEQ ID NO: 749 |
| CGFFGAIWEFIKSILK | SEQ ID NO: 750 |
| CGFFEAIWEFIKSILK | SEQ ID NO: 751 |
| CGFFGAIWGLLKSILK | SEQ ID NO: 752 |
| CGFFEAIWGLLKSILK | SEQ ID NO: 753 |

TABLE 3-continued

Peptide Sequence Listing and ID

| Sequence | SEQ ID |
|---|---|
| CGFFEAIAGLLKSILK | SEQ ID NO: 754 |
| CGFFGAIAGLLKSILK | SEQ ID NO: 755 |
| CGIFEAIAGLLKNIFEGLI | SEQ ID NO: 756 |
| CGIFEAIWGLLKNIFKGLI | SEQ ID NO: 757 |
| CGIFEAIWGLLKNIFEGLI | SEQ ID NO: 758 |
| CGIFEAIAGLLKNILKGLIDGWYG | SEQ ID NO: 759 |
| CGIFGAIAGLLKNILKGLIDGWYG | SEQ ID NO: 760 |
| CGIFGAIAGLLKNIFKGLIDGWYG | SEQ ID NO: 761 |
| CGIFGAIWELWEWILK | SEQ ID NO: 762 |
| CGIFEAIWELWEWILK | SEQ ID NO: 763 |
| CIFGAIWELWEWILK | SEQ ID NO: 764 |
| CIFEAIWELWEWILK | SEQ ID NO: 765 |
| CGIFEAIAELWKNIFK | SEQ ID NO: 766 |
| CGIFEAIAELWENIFK | SEQ ID NO: 767 |
| CGIFEAIAELWKWIFK | SEQ ID NO: 768 |
| CGIFEAIAELWEWIFK | SEQ ID NO: 769 |
| CGIFEAIAGLLKNILKGLIDWWYG | SEQ ID NO: 770 |
| CGIFGAIAGLLKNILKGLIDWWYG | SEQ ID NO: 771 |
| CGIFGAIAGLLKNIFKGLIDWWYG | SEQ ID NO: 772 |
| CGIFEAIAGLLKNILKGLIDGWYGF | SEQ ID NO: 773 |
| CGIFGAIAGLLKNILKGLIDGWYGF | SEQ ID NO: 774 |
| CGIFGAIAGLLKNIFKGLIDGWYGF | SEQ ID NO: 775 |
| CGIFGAIAELLEKIFE | SEQ ID NO: 776 |
| CGIFEAIAELLEKIFE | SEQ ID NO: 777 |
| CGFIGAIAELLEKIFE | SEQ ID NO: 778 |
| CGIFGAIAELLEKIFK | SEQ ID NO: 779 |
| CGIFEAIAELLEKIFK | SEQ ID NO: 780 |
| CGFIGAIAELLEKIFK | SEQ ID NO: 781 |
| CGLFHALLHLLHSLWHLLLEA | SEQ ID NO: 782 |
| GLFHALLHLLHSLWHGLLEAC | SEQ ID NO: 783 |
| GFFHAFFHFFHSFWHGFFEAC | SEQ ID NO: 784 |
| GLFHALLHLLHSLWHLLLEAC | SEQ ID NO: 785 |
| CGLFHALLHLLHSLWHGLLEAK(stearyl) | SEQ ID NO: 786 |
| CGFFHAFFHFFHSFWHGFFEAK(stearyl) | SEQ ID NO: 787 |
| CGLFHALLHLLHSLWHLLLEAK(stearyl) | SEQ ID NO: 788 |
| (stearyl)GLFHALLHLLHSLWHGLLEAC | SEQ ID NO: 789 |
| (stearyl)GFFHAFFHFFHSFWHGFFEAC | SEQ ID NO: 790 |
| (stearyl)GLFHALLHLLHSLWHLLLEAC | SEQ ID NO: 791 |

TABLE 3-continued

Peptide Sequence Listing and ID

| Sequence | SEQ ID |
|---|---|
| CGFFHAFFHFFHSFWHFFFEA | SEQ ID NO: 792 |
| CGFFHAFFHFFHSFWHLFFEA | SEQ ID NO: 793 |
| CGLFHALLHLLHSLWHGLLEW | SEQ ID NO: 794 |
| CGLFHALLHLLHSLWHLLLEW | SEQ ID NO: 795 |
| CGFFHAFFHFFHSFWHGFFEW | SEQ ID NO: 796 |
| CFFGAIWEFAKSIL | SEQ ID NO: 797 |
| CFFGAIWEFAHSIL | SEQ ID NO: 798 |
| CFFGAIWEFAHGIL | SEQ ID NO: 799 |
| CFFGAIWEFIHSILK | SEQ ID NO: 800 |
| CFFGAIWEFIHSILH | SEQ ID NO: 801 |
| CFFGAIWEFIHSILD | SEQ ID NO: 802 |
| CFFGAIWEFIHSILR | SEQ ID NO: 803 |
| CFFGAIWEFIHSILO | SEQ ID NO: 804 |
| CFFGAIAEFIHSIL | SEQ ID NO: 805 |
| CIFGAIWEFIHSIL | SEQ ID NO: 806 |
| CGIFGAIWEFIHSIL | SEQ ID NO: 807 |
| CFFGAIWEFIHSILE | SEQ ID NO: 808 |
| CFFGAIWEFIHSILEG | SEQ ID NO: 809 |
| CFFGAIWEFIHSILEGL | SEQ ID NO: 810 |
| CFFGAIWEFIHSILEGLI | SEQ ID NO: 811 |
| CFFGAIWEFIHSILEGLID | SEQ ID NO: 812 |
| CFFGAIWEFIHSILEGLIDG | SEQ ID NO: 813 |
| CFFGAIWEFIHSILEGLIEA | SEQ ID NO: 814 |
| CFFGAIWEFIHSILEGLIDW | SEQ ID NO: 815 |
| CFFGAIWEFIHSILEGLIDGWYG | SEQ ID NO: 816 |
| CFFGAIWEFIHSILEGLIDGWYGF | SEQ ID NO: 817 |
| FFGAIWEFIHSILC | SEQ ID NO: 818 |
| CFWGAIWEFIHSIL | SEQ ID NO: 819 |
| CFFGAIWEFIHSILKGLIDW | SEQ ID NO: 820 |
| CAFGKIWEFAHSIL | SEQ ID NO: 821 |
| CAFGKIWEFIHSIL | SEQ ID NO: 822 |
| CFFGKIWEFIHSIL | SEQ ID NO: 823 |
| CAFGAIWEFIHSIL | SEQ ID NO: 824 |
| CAFGAIWEFAHSIL | SEQ ID NO: 825 |
| CGFFGAIAGLLHNIFK | SEQ ID NO: 826 |
| CFFGAIAGLLHNIFK | SEQ ID NO: 827 |
| CGFFEAIEGLLHNIFK | SEQ ID NO: 828 |
| CFFEAIAGLLHNIFK | SEQ ID NO: 829 |

TABLE 3-continued

Peptide Sequence Listing and ID

| Sequence | SEQ ID |
|---|---|
| CFFEAIWGLLHNIFK | SEQ ID NO: 830 |
| CGFFGAIAELLHNIFK | SEQ ID NO: 831 |
| CFFGAIAELLHNIFK | SEQ ID NO: 832 |
| CGFFEAIAELLHNIFK | SEQ ID NO: 833 |
| CFFEAIAELLHNIFK | SEQ ID NO: 834 |
| CFFGAIWELLHNIFK | SEQ ID NO: 835 |
| CFFEAIWELLHNIFK | SEQ ID NO: 836 |
| CFFGAIWEFIHSILFFGAIWEFIHSIL | SEQ ID NO: 837 |
| CFFGAIWEFIHSILGGGFFGAIWEFIHSIL | SEQ ID NO: 838 |
| CFFGAIWEFIHSILGFFGAIWEFIHSIL | SEQ ID NO: 839 |
| GGLFEALLELLESLWELLLEW | SEQ ID NO: 840 |
| GGFFEAFFEFFESFWEFFFEA | SEQ ID NO: 841 |
| GGLFEALLELLESLWEGLLEA | SEQ ID NO: 842 |
| CGLFHALLHLLHSLWHLLLHA | SEQ ID NO: 843 |
| CGLFEALLHLLHSLWHLLLEA | SEQ ID NO: 844 |
| CGLFEALLELLHSLWHLLLEA | SEQ ID NO: 845 |
| CGLFEALLHLLESLWHLLLEA | SEQ ID NO: 846 |
| CGLFEALLHLLHSLWELLLEA | SEQ ID NO: 847 |
| CGLFHALLELLHSLWHLLLEA | SEQ ID NO: 848 |
| CGLFHALLHLLESLWHLLLEA | SEQ ID NO: 849 |
| CGLFHALLHLLHSLWELLLEA | SEQ ID NO: 850 |
| CGLFHALLELLESLWHLLLEA | SEQ ID NO: 851 |
| CGLFHALLELLHSLWELLLEA | SEQ ID NO: 852 |
| CGLFHALLHLLESLWELLLEA | SEQ ID NO: 853 |
| CGLFEALLHLLESLWELLLEA | SEQ ID NO: 854 |
| CGLFEALLELLHSLWELLLEA | SEQ ID NO: 855 |
| CGLEALLELLESLWHLLLEA | SEQ ID NO: 856 |
| CGLFHALLELLESLWELLLEA | SEQ ID NO: 857 |
| CFFGAIWEFIHSILHLLLEA | SEQ ID NO: 858 |
| CFFGAIWEFIHSILKLLLEA | SEQ ID NO: 859 |
| CGFFGAIWEFIHSILGFFGAIWEFIHSIL | SEQ ID NO: 860 |
| CFFGAIWEFAHSILFFGAIWEFAHSIL | SEQ ID NO: 861 |
| CFFGAIWEFAHSILGFFGAIWEFAHSIL | SEQ ID NO: 862 |
| CGFFGAIWEFAHSILGFFGAIWEFAHSIL | SEQ ID NO: 863 |
| CFFGAIWEFIHSILGLFEAIEGFIENGWEGMIDG | SEQ ID NO: 864 |
| CFFGAIWEFIHSILGLFEAIEGFIENGWEGMIDGWYG | SEQ ID NO: 865 |
| CFFGAIWEFIHSILGLFEAIEGFIENGWEGMIDGWYGF | SEQ ID NO: 866 |
| CFFGALLEFIHSILELLLEA | SEQ ID NO: 867 |

TABLE 3-continued

Peptide Sequence Listing and ID

| Sequence | SEQ ID |
|---|---|
| CGLFGALLEFIHSILELLLEA | SEQ ID NO: 868 |
| CGFFGALLEFIHSILELLLEA | SEQ ID NO: 869 |
| CFFGALLEFIHSLWELLLEA | SEQ ID NO: 870 |
| CGLFGALLEFIHSLWELLLEA | SEQ ID NO: 871 |
| CGFFGALLEFIHSLWELLLEA | SEQ ID NO: 872 |
| CIFGAIAGFIKNIWK(stearyl) | SEQ ID NO: 873 |
| (stearyl)IFGAIAGFIKNIWC | SEQ ID NO: 874 |
| CFFGAIWEFIKSILK(stearyl) | SEQ ID NO: 875 |
| (stearyl)FFGAIWEFIKSILC | SEQ ID NO: 876 |
| CFFGAIWEFIHSILK(stearyl) | SEQ ID NO: 877 |
| (stearyl)FFGAIWEFIHSILC | SEQ ID NO: 878 |
| CIFGAIAGFIKNIWEGLIK(stearyl) | SEQ ID NO: 879 |
| (stearyl)IFGAIAGFIKNIWEGLIC | SEQ ID NO: 880 |
| (stearyl)IFGAIAGFIKNILKGLC | SEQ ID NO: 881 |
| (stearyl)GIFGAIAGFIKNILKGLC | SEQ ID NO: 882 |
| CIFGAIAGFIKNILKGLK(stearyl) | SEQ ID NO: 883 |
| CGLFGAIAGFIVNGWVGMIDG | SEQ ID NO: 884 |
| CGLFGAIAGFIVNGWVGMIDGWYG | SEQ ID NO: 885 |
| CGLFEAIEGFIVNGWVGMIDGWYG | SEQ ID NO: 886 |
| CGLFGAIAGFIVNGWVGMIDGWYGF | SEQ ID NO: 887 |
| CGLFEAIEAGFIVNGWVGMIDGWYGF | SEQ ID NO: 888 |
| CGLFGAIAGFIVNGWVGMIDGWYGK(stearyl) | SEQ ID NO: 889 |
| CGLFEAIEGFIVNGWVGMIDGWYGK(stearyl) | SEQ ID NO: 890 |
| (stearyl)GLFGAIAGFIVNGWVGMIDGWYGC | SEQ ID NO: 891 |
| (stearyl)GLFEAIEGFIVNGWVGMIDGWYGC | SEQ ID NO: 892 |
| (stearyl)GLFGAIAGFIVNGWVGMIDGWYGFC | SEQ ID NO: 893 |
| (stearyl)GLFEAlEAGFIVNGWVGMIDGWYGFC | SEQ ID NO: 894 |
| CFFGAIWGLLHSILH | SEQ ID NO: 895 |
| CFFGAIWELLHSIL | SEQ ID NO: 896 |
| CFFGAIWELLHSILH | SEQ ID NO: 897 |
| CFFGAIWGLLHSILK | SEQ ID NO: 898 |
| CFFGAIWELLHSILK | SEQ ID NO: 899 |
| CGLFGALLHLLHSLWELLLEA | SEQ ID NO: 900 |
| CGLFGALLELLHSLWELLLEA | SEQ ID NO: 901 |
| CFFGAIWEFIHSILELLLEA | SEQ ID NO: 902 |
| CFFGAIWEFIHSILHGLLEA | SEQ ID NO: 903 |
| CFFGAIWEFIHSILEGLLEA | SEQ ID NO: 904 |
| CGFFGAIWEFIHSILHLLLEA | SEQ ID NO: 905 |

TABLE 3-continued

Peptide Sequence Listing and ID

| Sequence | SEQ ID |
|---|---|
| CGFFGAIWEFIHSILELLLEA | SEQ ID NO: 906 |
| CGFFGAIWEFIHSILHGLLEA | SEQ ID NO: 907 |
| CGFFGAIWEFIHSILEGLLEA | SEQ ID NO: 908 |
| CGFFGAIAGLLHSIL | SEQ ID NO: 909 |
| CGFFGAIWGLLHSIL | SEQ ID NO: 910 |
| CGFFGALLGLLHSIL | SEQ ID NO: 911 |
| CFFGAIWEFAKSAL | SEQ ID NO: 912 |
| CIFGAIAGFIHNILKGL | SEQ ID NO: 913 |
| CFFGAIAGFIKNILKGL | SEQ ID NO: 914 |
| CIFGAIWGFIKNILKGL | SEQ ID NO: 915 |
| CIFGAIWGFIHNILKGL | SEQ ID NO: 916 |
| CIFGAIAGLLKNILKGL | SEQ ID NO: 917 |
| CIFGAIAGLLHNILKGL | SEQ ID NO: 918 |
| CIFEAIAGFIKNILKGL | SEQ ID NO: 919 |
| CIFEAIAGFIHNILKGL | SEQ ID NO: 920 |
| CGNFGEIAELIEEGLKNLIDWWNG | SEQ ID NO: 921 |
| CGFFGEIAELIEEGLENLIDWWNG | SEQ ID NO: 922 |
| CGNFGEIEELIEEGLKNLIDWWNG | SEQ ID NO: 923 |
| CGNFGEIAELIEEGLENLIDWWNG | SEQ ID NO: 924 |
| CGFFGEIEELIEENGENLIDWWNG | SEQ ID NO: 925 |
| CGFFGAIEELIEEGLKNLIDWWNG | SEQ ID NO: 926 |
| CGFFGAIAELIEEGLKNLIDWWNG | SEQ ID NO: 927 |
| CGFFGEIAELIEEGLKNLIDWWNGF | SEQ ID NO: 928 |
| GFFGEIAELIEEGLKNLIDWWNGC | SEQ ID NO: 929 |
| GNWWDILNKLGEEILEAIEGFFGC | SEQ ID NO: 930 |
| CGNWWDILNKLGEEILEAIEGFFG | SEQ ID NO: 931 |
| CGFLGEIAELIEEGLKNLIDWWNG | SEQ ID NO: 932 |
| CGFFGEIWELIEEGLKNLIDWWNG | SEQ ID NO: 933 |
| CGFFGEIAELWEEGLKNLIDWWNG | SEQ ID NO: 934 |
| CGFFGEIAELIWEGLKNLIDWWNG | SEQ ID NO: 935 |
| CGFFGEIAELIEWGLKNLIDWWNG | SEQ ID NO: 936 |
| CGFFGEIAELIEEGLRNLIDWWNG | SEQ ID NO: 937 |
| CGFFGEIAELIEEGLDNLIDWWNG | SEQ ID NO: 938 |
| CGFFGEIAELIEEGLKNLNDWWNG | SEQ ID NO: 939 |
| CGFFGEIEELIEEGLKNLIDWWNG | SEQ ID NO: 940 |
| CGFLGEIEELIEEGLKNLIDWWNG | SEQ ID NO: 941 |
| CGFFGLIEELIEEGLKNLIDWWNG | SEQ ID NO: 942 |
| CGFFGEIAELIEEGLKNLIDWWNGK(stearyl) | SEQ ID NO: 943 |

TABLE 3-continued

Peptide Sequence Listing and ID

| Sequence | SEQ ID |
|---|---|
| (stearyl)GFFGEIAELIEEGLKNLIDWWNGC | SEQ ID NO: 944 |
| CFFGAIWEFAKSILK(stearyl) | SEQ ID NO: 945 |
| CGFFGAIWEFAKSIL | SEQ ID NO: 946 |
| CFFGKIWEFIKSILK(stearyl) | SEQ ID NO: 947 |
| (stearyl)FFGKIWEFIKSILC | SEQ ID NO: 948 |
| CFFGAIWEFIKSIAK(stearyl) | SEQ ID NO: 949 |
| (stearyl)FFGAIWEFIKSIAC | SEQ ID NO: 950 |
| (stearyl)FFGAIWEFAKSILC | SEQ ID NO: 951 |
| CFFGGIWEFIKSILK(stearyl) | SEQ ID NO: 952 |
| (stearyl)FFGGIWEFIKSILC | SEQ ID NO: 953 |
| CFFKAIWEFIKSILK(stearyl) | SEQ ID NO: 954 |
| (stearyl)FFKAIWEFIKSILC | SEQ ID NO: 955 |
| CFFGAIWEAIKSILK(stearyl) | SEQ ID NO: 956 |
| (stearyl)FFGAIWEAIKSILC | SEQ ID NO: 957 |
| CFFKAIWEFAKSIL | SEQ ID NO: 958 |
| CFFKAIWEFAHSIL | SEQ ID NO: 959 |
| CFFKAIWEFAKSILK(stearyl) | SEQ ID NO: 960 |
| (stearyl)FFKAIWEFAKSILC | SEQ ID NO: 961 |
| CFFKAIWEFAHSILK(stearyl) | SEQ ID NO: 962 |
| CGLFGEIAELIEEGLENLIDWWNG | SEQ ID NO: 963 |
| CGLFGEIEELIEEGLKNLIDWWNG | SEQ ID NO: 964 |
| CFFGAIWEFAKSILK(stearyl) | SEQ ID NO: 965 |
| CGLFGEIEELIEEGLKGLIDWWNG | SEQ ID NO: 966 |
| CGLFGEIAELIEEGLKNLIDWWNG | SEQ ID NO: 967 |
| CGLFGEIAELIEEGLEGLIDWWNG | SEQ ID NO: 968 |
| GLFGEIEELIEEGLENLIDWWNGC | SEQ ID NO: 969 |
| (stearyl)GLFGEIEELIEEGLENLIDWWNGC | SEQ ID NO: 970 |
| CGLFGEIEELIEEGLENLIDWWNGK(stearyl) | SEQ ID NO: 971 |
| CGNWWDILNELGEEILEEIEGFLG | SEQ ID NO: 972 |
| CALFGEIEELIEEGLENLIDWWNG | SEQ ID NO: 973 |
| CELFGEIEELIEEGLENLIDWWNG | SEQ ID NO: 974 |
| CSLFGEIEELIEEGLENLIDWWNG | SEQ ID NO: 975 |
| CNLFGEIEELIEEGLENLIDWWNG | SEQ ID NO: 976 |
| CVLFGEIEELIEEGLENLIDWWNG | SEQ ID NO: 977 |
| CGFFGEIEELIEEGLENLIDWWNG | SEQ ID NO: 978 |
| CGVFGEIEELIEEGLENLIDWWNG | SEQ ID NO: 979 |
| CGIFGEIEELIEEGLENLIDWWNG | SEQ ID NO: 980 |
| CGWFGEIEELIEEGLENLIDWWNG | SEQ ID NO: 981 |

TABLE 3-continued

Peptide Sequence Listing and ID

| Sequence | SEQ ID |
|---|---|
| CGYFGEIEELIEEGLENLIDWWNG | SEQ ID NO: 982 |
| CGLLGEIEELIEEGLENLIDWWNG | SEQ ID NO: 983 |
| CGLVGEIEELIEEGLENLIDWWNG | SEQ ID NO: 984 |
| CGLIGEIEELIEEGLENLIDWWNG | SEQ ID NO: 985 |
| CGLWGEIEELIEEGLENLIDWWNG | SEQ ID NO: 986 |
| CGLYGEIEELIEEGLENLIDWWNG | SEQ ID NO: 987 |
| CGLFEEIEELIEEGLENLIDWWNG | SEQ ID NO: 988 |
| CGLFAEIEELIEEGLENLIDWWNG | SEQ ID NO: 989 |
| CGLFNEIEELIEEGLENLIDWWNG | SEQ ID NO: 990 |
| CGLFSEIEELIEEGLENLIDWWNG | SEQ ID NO: 991 |
| CGLFGAIEELIEEGLENLIDWWNG | SEQ ID NO: 992 |
| CGLFGDIEELIEEGLENLIDWWNG | SEQ ID NO: 993 |
| CGLFGNIEELIEEGLENLIDWWNG | SEQ ID NO: 994 |
| CGLFGSIEELIEEGLENLIDWWNG | SEQ ID NO: 995 |
| CGLFGELEELIEEGLENLIDWWNG | SEQ ID NO: 996 |
| CGLFGEVEELIEEGLENLIDWWNG | SEQ ID NO: 997 |
| CGLFGEFEELIEEGLENLIDWWNG | SEQ ID NO: 998 |
| CGLFGEWEELIEEGLENLIDWWNG | SEQ ID NO: 999 |
| CGLFGEYEELIEEGLENLIDWWNG | SEQ ID NO: 1000 |
| CGLFGEIAELIEEGLENLIDWWNG | SEQ ID NO: 1001 |
| CGLFGEIGELIEEGLENLIDWWNG | SEQ ID NO: 1002 |
| CGLFGEILELIEEGLENLIDWWNG | SEQ ID NO: 1003 |
| CGLFGEIVELIEEGLENLIDWWNG | SEQ ID NO: 1004 |
| CGLFGEISELIEEGLENLIDWWNG | SEQ ID NO: 1005 |
| CGLFGEIEDLIEEGLENLIDWWNG | SEQ ID NO: 1006 |
| CGLFGEIENLIEEGLENLIDWWNG | SEQ ID NO: 1007 |
| CGLFGEIESLIEEGLENLIDWWNG | SEQ ID NO: 1008 |
| CGLFGEIEALIEEGLENLIDWWNG | SEQ ID NO: 1009 |
| CGLFGEIEGLIEEGLENLIDWWNG | SEQ ID NO: 1010 |
| CGLFGEIEEVIEEGLENLIDWWNG | SEQ ID NO: 1011 |
| CGLFGEIEEIIEEGLENLIDWWNG | SEQ ID NO: 1012 |
| CGLFGEIEEFIEEGLENLIDWWNG | SEQ ID NO: 1013 |
| CGLFGEIEEAIEEGLENLIDWWNG | SEQ ID NO: 1014 |
| CGLFGEIEEYIEEGLENLIDWWNG | SEQ ID NO: 1015 |
| CGLFGEIEEWIEEGLENLIDWWNG | SEQ ID NO: 1016 |
| CGLFGEIEELVEEGLENLIDWWNG | SEQ ID NO: 1017 |
| CGLFGEIEELLEEGLENLIDWWNG | SEQ ID NO: 1018 |
| CGLFGEIEELFEEGLENLIDWWNG | SEQ ID NO: 1019 |

TABLE 3-continued

Peptide Sequence Listing and ID

| Sequence | SEQ ID |
|---|---|
| CGLFGEIEELAEEGLENLIDWWNG | SEQ ID NO: 1020 |
| CGLFGEIEELYEEGLENLIDWWNG | SEQ ID NO: 1021 |
| CGLFGEIEELWEEGLENLIDWWNG | SEQ ID NO: 1022 |
| CGLFGEIEELIDEGLENLIDWWNG | SEQ ID NO: 1023 |
| CGLFGEIEELINEGLENLIDWWNG | SEQ ID NO: 1024 |
| CGLFGEIEELISEGLENLIDWWNG | SEQ ID NO: 1025 |
| CGLFGEIEELIEDGLENLIDWWNG | SEQ ID NO: 1026 |
| CGLFGEIEELIEYGLENLIDWWNG | SEQ ID NO: 1027 |
| CGLFGEIEELIESGLENLIDWWNG | SEQ ID NO: 1028 |
| CGLFGEIEELIEQGLENLIDWWNG | SEQ ID NO: 1029 |
| CGLFGEIEELIENGLENLIDWWNG | SEQ ID NO: 1030 |
| CGLFGEIEELIEEALENLIDWWNG | SEQ ID NO: 1031 |
| CGLFGEIEELIEENLENLIDWWNG | SEQ ID NO: 1032 |
| CGLFGEIEELIEESLENLIDWWNG | SEQ ID NO: 1033 |
| CGLFGEIEELIEEQLENLIDWWNG | SEQ ID NO: 1034 |
| CGLFGEIEELIEEGWENLIDWWNG | SEQ ID NO: 1035 |
| CGLFGEIEELIEEGVENLIDWWNG | SEQ ID NO: 1036 |
| CGLFGEIEELIEEGIENLIDWWNG | SEQ ID NO: 1037 |
| CGLFGEIEELIEEGFENLIDWWNG | SEQ ID NO: 1038 |
| CGLFGEIEELIEEGAENLIDWWNG | SEQ ID NO: 1039 |
| CGLFGEIEELIEEGYENLIDWWNG | SEQ ID NO: 1040 |
| CGLFGEIEELIEEGLRNLIDWWNG | SEQ ID NO: 1041 |
| CGLFGEIEELIEEGLHNLIDWWNG | SEQ ID NO: 1042 |
| CGLFGEIEELIEEGLONLIDWWNG | SEQ ID NO: 1043 |
| CGLFGEIEELIEEGLDNLIDWWNG | SEQ ID NO: 1044 |
| CGLFGEIEELIEEGLKNLIDWWNG | SEQ ID NO: 1045 |
| CGLFGEIEELIEEGLEGLIDWWNG | SEQ ID NO: 1046 |
| CGLFGEIEELIEEGLEYLIDWWNG | SEQ ID NO: 1047 |
| CGLFGEIEELIEEGLEQLIDWWNG | SEQ ID NO: 1048 |
| CGLFGEIEELIEEGLESLIDWWNG | SEQ ID NO: 1049 |
| CGLFGEIEELIEEGLEALIDWWNG | SEQ ID NO: 1050 |
| CGLFGEIEELIEEGLE(Cit)LIDWWNG | SEQ ID NO: 1051 |
| CGLFGEIEELIEEGLENMIDWWNG | SEQ ID NO: 1052 |
| CGLFGEIEELIEEGLENFIDWWNG | SEQ ID NO: 1053 |
| CGLFGEIEELIEEGLENIIDWWNG | SEQ ID NO: 1054 |
| CGLFGEIEELIEEGLENWIDWWNG | SEQ ID NO: 1055 |
| CGLFGEIEELIEEGLENVIDWWNG | SEQ ID NO: 1056 |
| CGLFGEIEELIEEGLENYIDWWNG | SEQ ID NO: 1057 |

TABLE 3-continued

Peptide Sequence Listing and ID

| Sequence | SEQ ID |
|---|---|
| CGLFGEIEELIEEGLEN(Nle)IDWWNG | SEQ ID NO: 1058 |
| CGLFGEIEELIEEGLENLIDWWNG | SEQ ID NO: 1059 |
| CGLFGEIEELIEEGLENLVDWWNG | SEQ ID NO: 1060 |
| CGLFGEIEELIEEGLENLFDWWNG | SEQ ID NO: 1061 |
| CGLFGEIEELIEEGLENLWDWWNG | SEQ ID NO: 1062 |
| CGLFGEIEELIEEGLENLYDWWNG | SEQ ID NO: 1063 |
| CGLFGEIEELIEEGLENLIEWWNG | SEQ ID NO: 1064 |
| CGLFGEIEELIEEGLENLINWWNG | SEQ ID NO: 1065 |
| CGLFGEIEELIEEGLENLISWWNG | SEQ ID NO: 1066 |
| CGLFGEIEELIEEGLENLIQWWNG | SEQ ID NO: 1067 |
| CGLFGEIEELIEEGLENLIDGWNG | SEQ ID NO: 1068 |
| CGLFGEIEELIEEGLENLIDAWNG | SEQ ID NO: 1069 |
| CGLFGEIEELIEEGLENLIDFWNG | SEQ ID NO: 1070 |
| CGLFGEIEELIEEGLENLIDLWNG | SEQ ID NO: 1071 |
| CGLFGEIEELIEEGLENLIDIWNG | SEQ ID NO: 1072 |
| CGLFGEIEELIEEGLENLIDVWNG | SEQ ID NO: 1073 |
| CGLFGEIEELIEEGLENLIDWGNG all (D) | SEQ ID NO: 1074 |
| CGLFGEIEELIEEGLENLIDWANG | SEQ ID NO: 1075 |
| CGLFGEIEELIEEGLENLIDWFNG | SEQ ID NO: 1076 |
| CGLFGEIEELIEEGLENLIDWING | SEQ ID NO: 1077 |
| CGLFGEIEELIEEGLENLIDWVNG | SEQ ID NO: 1078 |
| CGLFGEIEELIEEGLENLIDWYNG | SEQ ID NO: 1079 |
| CGLFGEIEELIEEGLENLIDWWQG | SEQ ID NO: 1080 |
| CGLFGEIEELIEEGLENLIDWWTG | SEQ ID NO: 1081 |
| CGLFGEIEELIEEGLENLIDWWSG | SEQ ID NO: 1082 |
| CGLFGEIEELIEEGLENLIDWWEG | SEQ ID NO: 1083 |
| CGLFGEIEELIEEGLENLIDWW(Cit)G | SEQ ID NO: 1084 |
| CGLFGEIEELIEEGLENLIDWWNA | SEQ ID NO: 1085 |
| CGLFGEIEELIEEGLENLIDWWNN | SEQ ID NO: 1086 |
| CGLFGEIEELIEEGLENLIDWWNS | SEQ ID NO: 1087 |
| CGLFGEIEELIEEGLENLIDWWNY | SEQ ID NO: 1088 |
| CGLFGEIEELIEEGLENLIDWWNW | SEQ ID NO: 1089 |
| CFFGAIWGLLHSIL | SEQ ID NO: 1090 |
| CFFGK(stearyl)IWEFIKSIL | SEQ ID NO: 1091 |
| CFFGK(stearyl)IWEFIHSIL | SEQ ID NO: 1092 |
| CFFK(stearyl)AIWEFIKSIL | SEQ ID NO: 1093 |
| CGFFGAIWGLLHSILK | SEQ ID NO: 1094 |
| CGFFEAIWGLLHSIL | SEQ ID NO: 1095 |

TABLE 3-continued

Peptide Sequence Listing and ID

| Sequence | SEQ ID |
|---|---|
| CFFGAIWGLLKSIL | SEQ ID NO: 1096 |
| CGFFGAIWGLLKSIL | SEQ ID NO: 1097 |
| CFFEAIWGLLKSIL | SEQ ID NO: 1098 |
| CGFFEAIWGLLKSIL | SEQ ID NO: 1099 |
| CFFGAIWGLLHSILKGLIDWWNG | SEQ ID NO: 1100 |
| CFFGAIWGLLHSILKGLIDGWYG | SEQ ID NO: 1101 |
| CGIFGAIAGLLKNIFKG | SEQ ID NO: 1102 |
| CGIFGAIAGLLKNIFKA | SEQ ID NO: 1103 |
| CGIFGAIAGLLKNIFKL | SEQ ID NO: 1104 |
| CGIFGAIAGLLKNIFKW | SEQ ID NO: 1105 |
| CGIFGAIAGLLKNIFKF | SEQ ID NO: 1106 |
| CGIFGAIAGLLKNIFKN | SEQ ID NO: 1107 |
| CGIFGAIAGLLKNIFKE | SEQ ID NO: 1108 |
| CGIFGAIAGLLKNIFKS | SEQ ID NO: 1109 |
| CGIFGAIAGLLKNIFK(stearyl) | SEQ ID NO: 1110 |
| CGIFGAIAGLLKNIFKK(stearyl) | SEQ ID NO: 1111 |
| (stearyl)GIFGAIAGLLKNIFKC | SEQ ID NO: 1112 |
| CGIFGAIAGLLKNIFK(lauryl) | SEQ ID NO: 1113 |
| CGIFGAIAGLLKNIFKK(lauryl) | SEQ ID NO: 1114 |
| (lauryl)GIFGAIAGLLKNIFKC | SEQ ID NO: 1115 |
| CGIFGAIAGLLHNIFK | SEQ ID NO: 1116 |
| CGIFGAIAGLLONIFK | SEQ ID NO: 1117 |
| CGIFGAIAGLLRNIFK | SEQ ID NO: 1118 |
| CGIFGAIAGLLENIFK | SEQ ID NO: 1119 |
| CGIFGAIAGLLDNIFK | SEQ ID NO: 1120 |
| CGIFGAIAGLLKNIFH | SEQ ID NO: 1121 |
| CGIFGAIAGLLKNIFO | SEQ ID NO: 1122 |
| CGIFGAIAGLLKINFE | SEQ ID NO: 1123 |
| CGIFGAIAGLLKNIFD | SEQ ID NO: 1124 |
| CGIFGAIAGLLKNIFN | SEQ ID NO: 1125 |
| CGIFGAIAGLLNNIFK | SEQ ID NO: 1126 |
| CGIFGIAIGLLKNIFKGIFGAIAGLLKNIFK | SEQ ID NO: 1127 |
| CGIFGAIWGLLKNIFKG | SEQ ID NO: 1128 |
| CGIFGAIWGLLKNIFKA | SEQ ID NO: 1129 |
| CGIFGAIWGLLKNIFKL | SEQ ID NO: 1130 |
| CGIFGAIWGLLKNIFKW | SEQ ID NO: 1131 |
| CGIFGAIWGLLKNIFKF | SEQ ID NO: 1132 |
| CGIFGAIWGLLKNIFKN | SEQ ID NO: 1133 |

TABLE 3-continued

Peptide Sequence Listing and ID

| Sequence | SEQ ID |
|---|---|
| CGIFGAIWGLLKNIFKE | SEQ ID NO: 1134 |
| CGIFGAIWGLLKNIFKS | SEQ ID NO: 1135 |
| CGIFGAIWGLLKNIFK(stearyl) | SEQ ID NO: 1136 |
| CGIFGAIWGLLKNIFKK(stearyl) | SEQ ID NO: 1137 |
| (stearyl)GIFGAIWGLLKNIFKC | SEQ ID NO: 1138 |
| CGIFGAIWGLLKNIFK(lauryl) | SEQ ID NO: 1139 |
| CGIFGAIWGLLKNIFKK(lauryl) | SEQ ID NO: 1140 |
| (lauryl)GIFGAIWGLLKNIFKC | SEQ ID NO: 1141 |
| CGIFGAIWGLLHNIFK | SEQ ID NO: 1142 |
| CGIFGAIWGLLONIFK | SEQ ID NO: 1143 |
| CGIFGAIWGLLRNIFK | SEQ ID NO: 1144 |
| CGIFGAIWGLLENIFK | SEQ ID NO: 1145 |
| CGIFGAIWGLLDNIFK | SEQ ID NO: 1146 |
| CGIFGAIWGLLKNIFH | SEQ ID NO: 1147 |
| CGIFGAIWGLLKNIFO | SEQ ID NO: 1148 |
| CGIFGAIWGLLKINFE | SEQ ID NO: 1149 |
| CGIFGAIWGLLKNIFD | SEQ ID NO: 1150 |
| CGIFGAIWGLLKNIFN | SEQ ID NO: 1151 |
| CGIFGAIWGLLNNIFK | SEQ ID NO: 1152 |
| CFFGAIWGLLKNIFK | SEQ ID NO: 1153 |
| CGFFGAIWGLLKNIFK | SEQ ID NO: 1154 |
| CIFGAIWGLLKNIFK | SEQ ID NO: 1155 |
| CGIFGAIWIGLLKNIFKGIFGAIWGLLKNIFK | SEQ ID NO: 1156 |
| CGIFGAIWGLLHNIFH | SEQ ID NO: 1157 |
| CGIFGAIWGLLONIFO | SEQ ID NO: 1158 |
| CGIFGAIAGLLHSILK | SEQ ID NO: 1159 |
| CGIFGAIWGLLHSILK | SEQ ID NO: 1160 |
| CGIFGAIAGLLHSIL | SEQ ID NO: 1161 |
| CGIFGAIWGLLHSIL | SEQ ID NO: 1162 |
| CGIFGAIWELLKNIFK | SEQ ID NO: 1163 |
| CGIFGAIWGLLHNIFHGIFGAIWGLLHNIFK | SEQ ID NO: 1164 |
| CGIFEAIWGLLHNIFHGIFEAIWGLLHNIFH | SEQ ID NO: 1165 |
| CGIFEAIWGLLKNIFHGIFEAIWGLLHNIFH | SEQ ID NO: 1166 |
| CGIFEAIWGLLKNIFKGIFEAIWELLKNIFH | SEQ ID NO: 1167 |
| CGIFEAIWGLLKNIFHGIFEAIWGLLKNIFH | SEQ ID NO: 1168 |
| CGLFEALLELLESLWELLLEAWNG | SEQ ID NO: 1169 |
| CGLFEALLELLESLWELLLEWWNG | SEQ ID NO: 1170 |
| CGLFGELEELLEEGLENLLDWWNG | SEQ ID NO: 1171 |

TABLE 3-continued

Peptide Sequence Listing and ID

| Sequence | SEQ ID |
|---|---|
| CGLFGELEELLEEGLENLLEWWNG | SEQ ID NO: 1172 |
| CGLFGELEELLEEGWELLLEAWNG | SEQ ID NO: 1173 |
| CGLFGELEELLEEGWELLLEWWNG | SEQ ID NO: 1174 |
| CGLFGELEELLEEGWELLLDWWNG | SEQ ID NO: 1175 |
| CGLFGALLELLEEGLENLIDWWNG | SEQ ID NO: 1176 |
| CGLFEALLELLEEGLENLIDWWNG | SEQ ID NO: 1177 |
| CGLFEALLELLESLLENLIDWWNG | SEQ ID NO: 1178 |
| CGLFGELAELLEEGLENLLDWWNG | SEQ ID NO: 1179 |
| GLFGEIEELIEEGLENLIDWWNG | SEQ ID NO: 1180 |
| CFFGNIWEFIHSIL | SEQ ID NO: 1181 |
| CFFGAIWNFIHSIL | SEQ ID NO: 1182 |
| CFFGNIWNFIHSIL | SEQ ID NO: 1183 |
| CGIFGNIWNFIKNIFK | SEQ ID NO: 1184 |
| CGIFGNIWNLLKNIFK | SEQ ID NO: 1185 |
| CGIFGNIWGLLKNIFK | SEQ ID NO: 1186 |
| CGIFGNIWNFIKNIFH | SEQ ID NO: 1187 |
| CGIFGNIWNLLKNIFH | SEQ ID NO: 1188 |
| CGIFGNIWGLLKNIFH | SEQ ID NO: 1189 |
| CGIFENIWNFIKNIFK | SEQ ID NO: 1190 |
| CGIFENIWNFIKNIFH | SEQ ID NO: 1191 |
| CGIFENIWGLLKNIFK | SEQ ID NO: 1192 |
| CGIFENIWGLLKNIFH | SEQ ID NO: 1193 |
| CGIFENIWNLLKNIFK | SEQ ID NO: 1194 |
| CGIFENIWNLLKNIFH | SEQ ID NO: 1195 |
| CGLFGAIAGLLENIFENLIDWWNG | SEQ ID NO: 1196 |
| CGLFGAIAGLLNKIFKNLIDWWNG | SEQ ID NO: 1197 |
| CGLFGAIAGLLENIFKNLIDWWNG | SEQ ID NO: 1198 |
| CGLFGAIAGLLKNIFENLIDWWNG | SEQ ID NO: 1199 |
| CGLFGAIAGLLKNIFHNLIDWWNG | SEQ ID NO: 1200 |
| CLIGAILKVLATGLPTLISWIKNKRKQ | SEQ ID NO: 1201 |
| CGLLEEIEELLEEGLENLIDWWNG | SEQ ID NO: 1202 |
| CGLFEELEELLEEGLENLIDWWNG | SEQ ID NO: 1203 |
| CGLFEELEELLEEGLENLIEA | SEQ ID NO: 1204 |
| CGLFEELEELLEEGLENLIEAWNG | SEQ ID NO: 1205 |
| CGLFEELEELLEEGLENLIEW | SEQ ID NO: 1206 |
| CGLFEELEELLEEGLENLIEWWNG | SEQ ID NO: 1207 |
| CGLFEELEELLEEGLENLIDA | SEQ ID NO: 1208 |
| CGLFEELEELLEEGLENLIDAWNG | SEQ ID NO: 1209 |

TABLE 3-continued

Peptide Sequence Listing and ID

| Sequence | SEQ ID |
|---|---|
| CGLFEELEELLEEGLENLIDW | SEQ ID NO: 1210 |
| CFLGALKFALKSLL | SEQ ID NO: 1211 |
| CFLGALHFALKSLL | SEQ ID NO: 1212 |
| CFLGALKFALHSLL | SEQ ID NO: 1213 |
| CFLGALHFALHSLL | SEQ ID NO: 1214 |
| FLGALKFALKSLLC | SEQ ID NO: 1215 |
| GFLGALKFALKSLLC | SEQ ID NO: 1216 |
| CGLFGELEELIEEGLENLLDWWNG | SEQ ID NO: 1217 |
| CGLFGEIEELLEEGLENLLDWWNG | SEQ ID NO: 1218 |
| CGLFGELEELLEEGLENLIDWWNG | SEQ ID NO: 1219 |
| CGLFGEIEELIEEGLENLMDWWNG | SEQ ID NO: 1220 |
| CGLFGEIEELIEEGLENLEDWWNG | SEQ ID NO: 1221 |
| CGLFGEIEELIEEGLENLDDWWNG | SEQ ID NO: 1222 |
| CGLFGEIEELIEEGLENLNDWWNG | SEQ ID NO: 1223 |
| CGLFGEIEELIEEGLENLSDWWNG | SEQ ID NO: 1224 |
| CGLFGEIEELIEEGLENLQDWWNG | SEQ ID NO: 1225 |
| CGLFGEIEELIEEGLENL-CIT-DWWNG | SEQ ID NO: 1226 |
| CGLFGEIEELIEELLENLIDWWNG | SEQ ID NO: 1227 |
| CGLFGEIEELIEEILENLIDWWNG | SEQ ID NO: 1228 |
| CGLFGEIEELIEEVLENLIDWWNG | SEQ ID NO: 1229 |
| CFLGALWKLLSHLL | SEQ ID NO: 1230 |
| CFLGALWKILSHLL | SEQ ID NO: 1231 |
| CFLGALWVKVLSHLL | SEQ ID NO: 1232 |
| CFLGALWKFLSHLL | SEQ ID NO: 1233 |
| CFLEALWKALSHLL | SEQ ID NO: 1234 |
| CFLHALWKALSHLL | SEQ ID NO: 1235 |
| CFLKALWKALSHLL | SEQ ID NO: 1236 |
| CFLNALWKALSHLL | SEQ ID NO: 1237 |
| CFLSALWKALSHLL | SEQ ID NO: 1238 |
| CFLQALWKALSHLL | SEQ ID NO: 1239 |
| CFLEALWEALSHLL | SEQ ID NO: 1240 |
| CFLGALWEALSHLL | SEQ ID NO: 1241 |
| CFLEALWKLLSHLL | SEQ ID NO: 1242 |
| CFLEALWEALEELL | SEQ ID NO: 1243 |
| CFLEELWEALEELL | SEQ ID NO: 1244 |
| CFLEALWEALEHLL | SEQ ID NO: 1245 |
| CFLEELWEALEHLL | SEQ ID NO: 1246 |
| CFLEELWELLEELL | SEQ ID NO: 1247 |

TABLE 3-continued

Peptide Sequence Listing and ID

| Sequence | SEQ ID |
|---|---|
| CFLEELWELLEHLL | SEQ ID NO: 1248 |
| CGLFGEIEELLEEGLE-CIT-LIDWWNG | SEQ ID NO: 1249 |
| CGLFEEIEELLEEGLE-CIT-LIDWWNG | SEQ ID NO: 1250 |
| CGLFGEIAELLEEGLE-CIT-LIDWWNG | SEQ ID NO: 1251 |
| CGLFEEIAELLEEGLE-CIT-LIDWWNG | SEQ ID NO: 1252 |
| CGLFGEIEELLEEGLE-CIT-LVDWWNG | SEQ ID NO: 1253 |
| CGLFEEIEELLEEGLE-CIT-LVDWWNG | SEQ ID NO: 1254 |
| CGLFGEIAELLEEGLE-CIT-LVDWWNG | SEQ ID NO: 1255 |
| CGLFEEIAELLEEGLE-CIT-LVDWWNG | SEQ ID NO: 1256 |
| CGLFGEIEELLEEGLE-CIT-LIDWWNE | SEQ ID NO: 1257 |
| CGLFEEIEELLEEGLE-CIT-LIDWWNE | SEQ ID NO: 1258 |
| CGLFGEIAELLEEGLE-CIT-LIDWWNE | SEQ ID NO: 1259 |
| CGLFEEIAELLEEGLE-CIT-LIDWWNE | SEQ ID NO: 1260 |
| CGLFGEIEELLEEGLH-CIT-LIDWWNG | SEQ ID NO: 1261 |
| CGLFEEIEELLEEGLH-CIT-LIDWWNG | SEQ ID NO: 1262 |
| CGLFGEIAELLEEGLH-CIT-LIDWWNG | SEQ ID NO: 1263 |
| CGLFEEIAELLEEGLH-CIT-LIDWWNG | SEQ ID NO: 1264 |
| CGLFGEIEELLEEGLE-CIT-LVDWWNE | SEQ ID NO: 1265 |
| CGLFEEIEELLEEGLE-CIT-LVDWWNE | SEQ ID NO: 1266 |
| CGLFGEIAELLEEGLE-CIT-LVDWWNE | SEQ ID NO: 1267 |
| CGLFEEIAELLEEGLE-CIT-LVDWWNE | SEQ ID NO: 1268 |
| CFFKNIWEFIKSIL | SEQ ID NO: 1269 |
| CFFKNIWNFIKSIL | SEQ ID NO: 1270 |
| CFFKAIWEFIKSILE | SEQ ID NO: 1271 |
| CFFKAIWEFIKNIFK | SEQ ID NO: 1272 |
| CFFKAIWEFIKNIFKE | SEQ ID NO: 1273 |
| CFFKAIWELLKSIL | SEQ ID NO: 1274 |
| CFFKAIWGLLKSIL | SEQ ID NO: 1275 |
| CFFKAIWEFIKSILK | SEQ ID NO: 1276 |
| CFFKNIWGLLKSIL | SEQ ID NO: 1277 |
| CFFKAIWGLLKNIFK | SEQ ID NO: 1278 |
| CFFKAIWELLKNIFK | SEQ ID NO: 1279 |
| CFFKNIWGLLKNIFK | SEQ ID NO: 1280 |
| CFFKNIWELLKNIFK | SEQ ID NO: 1281 |
| CFFKAIWEFIRSIL | SEQ ID NO: 1282 |
| CFFKAIWEFIKSLL | SEQ ID NO: 1283 |
| CFFKAIWEFIKSAL | SEQ ID NO: 1284 |
| CFFKAIWEFIKSIF | SEQ ID NO: 1285 |

TABLE 3-continued

Peptide Sequence Listing and ID

| Sequence | SEQ ID |
|---|---|
| CFFKALWEFLKSLL | SEQ ID NO: 1286 |
| CIFKAIWEFIKSIL | SEQ ID NO: 1287 |
| CFFKAIWEFIKSIW | SEQ ID NO: 1288 |
| CFFHAIWEFIKSIL | SEQ ID NO: 1289 |
| CFFEAIWEFIKSIL | SEQ ID NO: 1290 |
| CFFKAIAEFIKSIL | SEQ ID NO: 1291 |
| CFFKAIEEFIKSIL | SEQ ID NO: 1292 |
| CFFKAILEFIKSIL | SEQ ID NO: 1293 |
| CFFKAIFEFIKSIL | SEQ ID NO: 1294 |
| CFFKAIWGFIKSIL | SEQ ID NO: 1295 |
| CFFKAIWHFIKSIL | SEQ ID NO: 1296 |
| CFFKAIWKFIKSIL | SEQ ID NO: 1297 |
| CFFEAIWKFIKSIL | SEQ ID NO: 1298 |
| CFFKAIWELIKSIL | SEQ ID NO: 1299 |
| CFFKALWELLKSLL | SEQ ID NO: 1300 |
| CFFKAIWEAIKSIL | SEQ ID NO: 1301 |
| CFFKAIWEFLKSIL | SEQ ID NO: 1302 |
| CFFKAIWEFIHSIL | SEQ ID NO: 1303 |
| CFFKAIWEFIESIL | SEQ ID NO: 1304 |
| CFFKAIWEFIKNIL | SEQ ID NO: 1305 |
| CFFKAIWEFIKWIL | SEQ ID NO: 1306 |
| CFFKAIWEFIKEIL | SEQ ID NO: 1307 |
| CFFKAIWEFIKGIL | SEQ ID NO: 1308 |
| CFFKAIWEFIKSGL | SEQ ID NO: 1309 |
| CFFKAIWEFIKSII | SEQ ID NO: 1310 |
| CFFKAIWEFIK-CIT-IL | SEQ ID NO: 1311 |
| CFFKAIWEFIKSIA | SEQ ID NO: 1312 |
| CFFKAIWEFIKQIL | SEQ ID NO: 1313 |
| CGFFKAIWEFIKSIL | SEQ ID NO: 1314 |
| CFFKAIWEFIKSILKGLIDG | SEQ ID NO: 1315 |
| CFFKAIWEFIKSILKGLIDGWYG | SEQ ID NO: 1316 |
| CFFKAIWEFIKSILEGLIDG | SEQ ID NO: 1317 |
| CFFKAIWEFIKSILEGLIDGWYG | SEQ ID NO: 1318 |
| CFFKAIWEFIKNIFKGLIDG | SEQ ID NO: 1319 |
| CFFKAIWEFIKNIFKGLIDGWYG | SEQ ID NO: 1320 |
| CFFGNIWEFIKSILKGLIDG | SEQ ID NO: 1321 |
| CFFGNIWEFIKSILKGLIDGWYG | SEQ ID NO: 1322 |
| CFFGNIWEFIKSILEGLIDG | SEQ ID NO: 1323 |

TABLE 3-continued

Peptide Sequence Listing and ID

| Sequence | SEQ ID |
|---|---|
| CFFGNIWEFIKSILEGLIDGWYG | SEQ ID NO: 1324 |
| CFFGNIWEFIKNIFKGLIDG | SEQ ID NO: 1325 |
| CFFGNIWEFIKNIFKGLIDGEYG | SEQ ID NO: 1326 |
| CFFKAIWGLLKSILKGLIDG | SEQ ID NO: 1327 |
| CFFKAIWGLLKSILKGLIDGWYG | SEQ ID NO: 1328 |
| CFFKAIWGLLKSILEGLIDG | SEQ ID NO: 1329 |
| CFFKAIWGLLKSILEGLIDGWYG | SEQ ID NO: 1330 |
| CFFKAIWGLLKNIFKGLIDG | SEQ ID NO: 1331 |
| CFFKAIWGLLKNIFKGLIDGWYG | SEQ ID NO: 1332 |
| CFFKAIWGLLKNIFEGLIDG | SEQ ID NO: 1333 |
| CFFKAIWGLLKNIFEGLIDGWYG | SEQ ID NO: 1334 |
| CFFKAIWEFIKSILKGLIDGWNG | SEQ ID NO: 1335 |
| CFFKAIWEFIKNIFKGLIDGWNG | SEQ ID NO: 1336 |
| CIFGAIAGLLKNILKGLIDG | SEQ ID NO: 1337 |
| CIFGAIAGLLKNILKGLIDGWYG | SEQ ID NO: 1338 |
| CFLEALWKALEHLL | SEQ ID NO: 1339 |
| CFLEALWEALSKLL | SEQ ID NO: 1340 |
| CFLEALWEALEKLL | SEQ ID NO: 1341 |
| CFLEALWEALEHLLK(stearyl) | SEQ ID NO: 1342 |
| (stearyl)FLEALWEALEHLLC | SEQ ID NO: 1343 |
| (stearyl)GFLEALWEALEHLLC | SEQ ID NO: 1344 |
| CFLEALWKALSKLL | SEQ ID NO: 1345 |
| CFLEALWEALDHLL | SEQ ID NO: 1346 |
| CFLEALWEALTHLL | SEQ ID NO: 1347 |
| CFLEALWEALNHLL | SEQ ID NO: 1348 |
| CFLEALWEALQHLL | SEQ ID NO: 1349 |
| CFLEALWEALEHLLH | SEQ ID NO: 1350 |
| CFLEALWEALEHLLK | SEQ ID NO: 1351 |
| CFLEALWEALEHLLE | SEQ ID NO: 1352 |
| CWLEALEALEHLL | SEQ ID NO: 1353 |
| CLLEALWEALEHLL | SEQ ID NO: 1354 |
| CFFEALWEALEHLL | SEQ ID NO: 1355 |
| CFLEALEEALEHLL | SEQ ID NO: 1356 |
| CFLEALAEALEHLL | SEQ ID NO: 1357 |
| CFLEALFEALEHLL | SEQ ID NO: 1358 |
| CLFEALWEALHHLL | SEQ ID NO: 1359 |
| CLFEALWEALKHLL | SEQ ID NO: 1360 |
| CFLEALWEALEHGL | SEQ ID NO: 1361 |

TABLE 3-continued

Peptide Sequence Listing and ID

| Sequence | SEQ ID |
|---|---|
| CLFEALWEALEHLF | SEQ ID NO: 1362 |
| CLFEALWEALEHFL | SEQ ID NO: 1363 |
| CLFEALWEALEHLLEGLIDWWYG | SEQ ID NO: 1364 |
| CLFEALWEALEHLLEGLIDWWNG | SEQ ID NO: 1365 |
| CLFEALWEALEHLLENLIDWWNG | SEQ ID NO: 1366 |
| CFLEELWELLEKLL | SEQ ID NO: 1367 |
| CFLEELWELLEELLE | SEQ ID NO: 1368 |
| CFLEELWELLEELLELLE | SEQ ID NO: 1369 |
| CFLEELWELLEHLLELLD | SEQ ID NO: 1370 |
| CFLEELWELLEELLELID | SEQ ID NO: 1371 |
| CFLEELWELLEELLELLD | SEQ ID NO: 1372 |
| CFLEELWELLEHLLEGLE | SEQ ID NO: 1373 |
| CFLEELWELLEHLLEGLD | SEQ ID NO: 1374 |
| CFLEELWELLEHLLEEGLI | SEQ ID NO: 1375 |
| CFLEELWELLEHLLEGLIDWWYG | SEQ ID NO: 1376 |
| CFLEELWELLEHLLENLIDWWNG | SEQ ID NO: 1377 |
| CFLEALWEALEHLLELLD | SEQ ID NO: 1378 |
| CGLFGELEELLEEGLENLTDWWNG | SEQ ID NO: 1379 |
| CGLFGELEELLEEGLENL-(ALLO-I)-DWWNG | SEQ ID NO: 1380 |
| CFLEALWEALEHLLELID | SEQ ID NO: 1381 |
| CELFEELEELLEEGLENLIDWWNG | SEQ ID NO: 1382 |
| CGLFEELEELLEEGLELLIDWWNG | SEQ ID NO: 1383 |
| CGLFEELEELLEEGLELLIDWWNK | SEQ ID NO: 1384 |
| CGLFEELEELLEEGLENLIDWWNK | SEQ ID NO: 1385 |
| CGLFGELEELLEEGLENLIDWWNQ | SEQ ID NO: 1386 |
| CGLFGELEELLEEGLENLIDWWNE | SEQ ID NO: 1387 |
| CGLFGELEELLEEGLENLIDWWNN | SEQ ID NO: 1388 |
| CGLFGELEELLEEGLENLIDWWNS | SEQ ID NO: 1389 |
| CGLFEELEELLEEGLENLIDWWNQ | SEQ ID NO: 1390 |
| AC-CFLEELWELLEHLL | SEQ ID NO: 1391 |
| AC-CFLEELWELLEELL | SEQ ID NO: 1392 |
| CGLLGEIEELLEEGLENLIDWWNG | SEQ ID NO: 1393 |
| CGLLAEIEELLEEGLENLIDWWNG | SEQ ID NO: 1394 |
| CGLLGEIEELLEEGLENLIDWWNQ | SEQ ID NO: 1395 |
| CGLLAEIEELLEEGLENLIDWWNQ | SEQ ID NO: 1396 |
| CGLLEEIEELLEEGLENLIDWWNQ | SEQ ID NO: 1397 |
| CGLLGEIEELLEEGLENLIDWWNE | SEQ ID NO: 1398 |
| CGLLAEIEELLEEGLENLIDWWNE | SEQ ID NO: 1399 |

TABLE 3-continued

Peptide Sequence Listing and ID

| Sequence | SEQ ID |
|---|---|
| CGLLEEIEELLEEGLENLIDWWNE | SEQ ID NO: 1400 |
| CGLLGEIEELLEEGLENLIDWWNS | SEQ ID NO: 1401 |
| CGLLAEIEELLEEGLENLIDWWNS | SEQ ID NO: 1402 |
| CGLLEEIEELLEEGLENLIDWWNS | SEQ ID NO: 1403 |
| CGLFAELEELLEEGLENLLEWWNG | SEQ ID NO: 1404 |
| CGLFEELEELLEEGLENLLEWWNG | SEQ ID NO: 1405 |
| CGLFGELEELLEEGLENLLEWWNE | SEQ ID NO: 1406 |
| CGLFAELEELLEEGLENLLEWWNE | SEQ ID NO: 1407 |
| CGLFEELEELLEEGLENLLEWWNE | SEQ ID NO: 1408 |
| CGLLGELEELLEEGLENLLEWWNG | SEQ ID NO: 1409 |
| CGLLGELEELLEEGLENLLEWWNE | SEQ ID NO: 1410 |
| CGILGEIEELLEEGLENLIDWWNG | SEQ ID NO: 1411 |
| CGILGEIEELLEEGLENLIDWWNE | SEQ ID NO: 1412 |
| CGILGEIEELLEEGLENLIDWWNS | SEQ ID NO: 1413 |
| CGILAEIEELLEEGLENLIDWWNG | SEQ ID NO: 1414 |
| CGILEEIEELLEEGLENLIDWWNG | SEQ ID NO: 1415 |
| CIFGAIAELLKNIFK | SEQ ID NO: 1416 |
| CIFGAIAELLENIFK | SEQ ID NO: 1417 |
| CIFGAIAGLLENIFK | SEQ ID NO: 1418 |
| CFLEELWGLLEHLL | SEQ ID NO: 1419 |
| CGILAEIEELLEEGLENLIDWWNQ | SEQ ID NO: 1420 |
| CGILAEIEELLEEGLENLIDWWNE | SEQ ID NO: 1421 |
| CGLFAEIEELLEEGLENLIDWWNQ | SEQ ID NO: 1422 |
| CGLFAEIEELLEEGLENLIDWWNE | SEQ ID NO: 1423 |
| CGLFGELEELLEEGLENLLEWWNQ | SEQ ID NO: 1424 |
| CGLFAEIAELLEEGLE-CIT-LIDWWNE | SEQ ID NO: 1425 |
| CGILAEIEELLEEGLENLLEWWNG | SEQ ID NO: 1426 |
| CGILEEIEELLEEGLENLIDWWNE | SEQ ID NO: 1427 |
| CGILEEIEELLEEGLENLIDWWNQ | SEQ ID NO: 1428 |
| CGLFGEIEELIWEGLENLIDWWNG | SEQ ID NO: 1429 |
| CGLFGEIAELIWEGLENLIDWWNG | SEQ ID NO: 1430 |
| CGLFEEIAELIEEGLENLIDWWNG | SEQ ID NO: 1431 |
| CGLFEEIAELIWEGLENLIDWWNG | SEQ ID NO: 1432 |
| CELFEEIAELIWEGLENLIDWWNG | SEQ ID NO: 1433 |
| CELFEEIAELLWEGLENLIDWWNG | SEQ ID NO: 1434 |
| CGLFEEIAELLWEGLENLIDWWNG | SEQ ID NO: 1435 |
| CGLFEELAELLWEGLENLIDWWNG | SEQ ID NO: 1436 |
| CELFEELAELLWEGLENLIDWWNG | SEQ ID NO: 1437 |

TABLE 3-continued

Peptide Sequence Listing and ID

| Sequence | SEQ ID |
|---|---|
| CELFEELAELLWEGLENLIDWWNS | SEQ ID NO: 1438 |
| CGLFEELAELLWEGLENLIDWWNS | SEQ ID NO: 1439 |
| CGIFEELAELLWEGLENLIDWWNG | SEQ ID NO: 1440 |
| CGIFEELAELLWEGLENLIDWWNS | SEQ ID NO: 1441 |
| CGLFEELEELLEELLENLIDWWNS | SEQ ID NO: 1442 |
| CELFEELEELLEELLENLIDWWNS | SEQ ID NO: 1443 |
| CELFEELEELLEELLELLIDWWNS | SEQ ID NO: 1444 |
| CEFLEELEELLEELLENLIDWWNS | SEQ ID NO: 1445 |
| CELFEELEELLEHLLENLIDWWNS | SEQ ID NO: 1446 |
| CELFEELEELLHELLENLIDWWNS | SEQ ID NO: 1447 |
| CGLFGELEELLWEGLENLIDWWNG | SEQ ID NO: 1448 |
| CGLFGELEELLWEGLHNLIDWWNG | SEQ ID NO: 1449 |
| CGLFGELWELLEHGLENLIDWWNG | SEQ ID NO: 1450 |
| CGL-R6H-GELEEL-S7H-EEGLENLIDWWNG | SEQ ID NO: 1451 |
| CGLFEAIEGFIENGWEGMIDGWNG | SEQ ID NO: 1452 |
| CGLFEAIEGFIENGWEGMIDWWNG | SEQ ID NO: 1453 |
| CGLFGAIEGFIENGWEGMIDWWNG | SEQ ID NO: 1454 |
| CGLFAEIEELLEEGLENLLEWWNG | SEQ ID NO: 1455 |
| CGLFAELEELLEEGLENLIDWWNG | SEQ ID NO: 1456 |
| CGIFAEIEELLEEGLENLIDWWNG | SEQ ID NO: 1457 |
| CGLFAEIEELLEEGLENLIDWWNGF | SEQ ID NO: 1458 |
| CGLFAEIEELLEEGLENLIDWWNA | SEQ ID NO: 1459 |
| CGLFAEIEELLEEGLENLIDWWNS | SEQ ID NO: 1460 |
| CGLFAEIEELLEEGLENLIDWWN-CIT | SEQ ID NO: 1461 |
| CGLFGEIAGLLEEGLHNLIDWWNG | SEQ ID NO: 1462 |
| CGLFGEIAGLLEQGLHNLIDWWNG | SEQ ID NO: 1463 |
| CGLFGEIAGLLESGLHNLIDWWNG | SEQ ID NO: 1464 |
| CGLFAEIAGLLEQGLHNLIDWWNG | SEQ ID NO: 1465 |
| CGLFAEIAGLLEEGLHNLIDWWNG | SEQ ID NO: 1466 |
| CGLFAEIAGLLESGLHNLIDWWNG | SEQ ID NO: 1467 |
| CGIFEAIAGLLEQGLHNLIDWWNG | SEQ ID NO: 1468 |
| CGLFGAIAELLEEGLHNLIDWWNG | SEQ ID NO: 1469 |
| CGLFAAIAELLEEGLHNLIDWWNG | SEQ ID NO: 1470 |
| CGIFEAIAGLLKNIFKNLIDWWNG | SEQ ID NO: 1471 |
| CGIFGAIWELLEQGLHNLIDWWNG | SEQ ID NO: 1472 |
| CGLFAELAGLLEQGLHNLIDWWNG | SEQ ID NO: 1473 |
| CGILAELAGLLEQGLHNLIDWWNG | SEQ ID NO: 1474 |
| CGLFGEIEELLEHLL | SEQ ID NO: 1475 |

TABLE 3-continued

Peptide Sequence Listing and ID

| Sequence | SEQ ID |
|---|---|
| CGLFGEIEELLEELL | SEQ ID NO: 1476 |
| CGLFGEIEELLEEGL | SEQ ID NO: 1477 |
| CGLFGEIEELLEHGL | SEQ ID NO: 1478 |
| CGLFHEIEELLEHLL | SEQ ID NO: 1479 |
| CFLGALWKALSELLE | SEQ ID NO: 1480 |
| CGLFGEIWELLEEGL | SEQ ID NO: 1481 |
| CGLFGEIWELLEEGLI | SEQ ID NO: 1482 |
| CGLFGEIWELLEELL | SEQ ID NO: 1483 |
| CGLFEEIEELLEELLE | SEQ ID NO: 1484 |
| CGLFELIEGFIEWGWEGMIDGWYGYGRKKRRQRR | SEQ ID NO: 1485 |
| CIFGAIAGFIKNIWLHLLHHLLHHLHHLLHHLLHL | SEQ ID NO: 1486 |
| CEALFGKINAIFIGKL | SEQ ID NO: 1487 |
| CEENWIGLFGGGNIWEEEEILDLL | SEQ ID NO: 1488 |
| CLELWLEHLFLELE | SEQ ID NO: 1489 |
| CGNFEEIEGFIENGWEGLIDGWYGYGRKKRRQRR | SEQ ID NO: 1490 |
| CRGKWYMGFGEIKRQGEGRRYGLFEDWIAENRGI | SEQ ID NO: 1491 |
| GLFEAIEGFIENGWEGLAELAEALEALAAGGSC | SEQ ID NO: 1492 |
| GLFGALAEALAEALAEHLAEALAEALEALAAGGSC | SEQ ID NO: 1493 |
| CGFFGEIAGLLENGLHNLIDWWNG | SEQ ID NO: 1494 |
| CGFFGEIAALLENGLENLIDWWNG | SEQ ID NO: 1495 |
| CGFFGEIAEFIHSGLKNLIDWWNG | SEQ ID NO: 1496 |
| CGFFGEIAGLLKNGLKNLIDWWNG | SEQ ID NO: 1497 |
| CGFFGEIAGFIKNGLKNLIDWWNG | SEQ ID NO: 1498 |
| CGFFGEIAEFIHSILKNLIDWWNG | SEQ ID NO: 1499 |
| CGFFGEIAGLLKNILKNLIDWWNG | SEQ ID NO: 1500 |
| CGFFGEIAGFIKNILKNLIDWWNG | SEQ ID NO: 1501 |
| CFLGALFHALSELL | SEQ ID NO: 1502 |
| CFLGALWHALSELL | SEQ ID NO: 1503 |
| CFLGALWHALSHLL | SEQ ID NO: 1504 |
| CFLGALWELLSHLL | SEQ ID NO: 1505 |
| CFLGALWKALSHLL | SEQ ID NO: 1506 |
| CFLGALWHALSKLL | SEQ ID NO: 1507 |
| CFLGALFHLLSHLL | SEQ ID NO: 1508 |
| CFLGALFHLLSELL | SEQ ID NO: 1509 |
| CFLGALWHLLSHLL | SEQ ID NO: 1510 |
| CFLGALWHLLSELL | SEQ ID NO: 1511 |
| CFLGALFHALSHLLE | SEQ ID NO: 1512 |
| CFLGALFHLLSHLLE | SEQ ID NO: 1513 |

TABLE 3-continued

Peptide Sequence Listing and ID

| Sequence | SEQ ID |
|---|---|
| CGLFGALFHALSHLLE | SEQ ID NO: 1514 |
| CFLGALWKALSHLL | SEQ ID NO: 1515 |
| CGLFAEIEELLEEGLENLIDWWNG | SEQ ID NO: 1516 |
| CGLFGEIEELIEEGLE-Cit-LIDWWNG | SEQ ID NO: 1517 |
| CGLFGEIEELIEEGLENLIDWWNE | SEQ ID NO: 1518 |
| CFFGAIWEFIHSILK(stearyl) | SEQ ID NO: 1519 |
| CIFGAIAGFIKNIWEGLIK(stearyl) | SEQ ID NO: 1520 |
| CGIFEAIAGLLKNIFK(stearyl) | SEQ ID NO: 1521 |
| CGIFEAIAGLLKNIFKK(stearyl) | SEQ ID NO: 1522 |
| CFLGALFHALSHLL | SEQ ID NO: 1523 |
| Ac-CIFGAIAGFIKNILKGLIDG | SEQ ID NO: 1524 |
| CIFGAIAGFIKNILKGLK(stearylL) | SEQ ID NO: 1525 |
| Ac-CIFGAIAGFIKNILKGLK(stearyl) | SEQ ID NO: 1526 |
| CGLFGEIEELIEEGLENLIDWWNG | SEQ ID NO: 1527 |
| CFLGALWKALSELLKNLIDWWNG | SEQ ID NO: 1528 |
| CGFLGALWKALSELLKNLIDWWNG | SEQ ID NO: 1529 |
| CFLGALFHALSHLLENLIDWWNG | SEQ ID NO: 1530 |
| CGFLGALFHALSHLLENLIDWWNG | SEQ ID NO: 1531 |
| CGLFGELEGFIENGLKNLIDWWNG | SEQ ID NO: 1532 |
| CGLFGELEGLLWHGLKNLIDWWNG | SEQ ID NO: 1533 |
| CGLFGELAELLWHGLKNLIDWWNG | SEQ ID NO: 1534 |
| CGLFGELAELLWQGLKNLIDWWNG | SEQ ID NO: 1535 |
| CGLFGELWELLWHGLKNLIDWWNG | SEQ ID NO: 1536 |
| CGLFGELWELLWQGLKNLIDWWNG | SEQ ID NO: 1537 |
| CGLFEELAGLLWHGLKNLIDWWNG | SEQ ID NO: 1538 |
| CGLFEELWGLLWHGLKNLIDWWNG | SEQ ID NO: 1539 |
| CGLFEELAGLLWQGLKNLIDWWNG | SEQ ID NO: 1540 |
| CGLFEELWGLLWQGLKNLIDWWNG | SEQ ID NO: 1541 |
| CGLFGELAELLWHGLKNLIDWWNK | SEQ ID NO: 1542 |
| CGLFEELAELLWHGLKNLIDWWNK | SEQ ID NO: 1543 |
| CGLFGELAELLWHGLKNLIDWWNH | SEQ ID NO: 1544 |
| CGLFEELAELLWHGLKNLIDWWNH | SEQ ID NO: 1545 |
| CGLFAELWGLLWQGLKNLIDWWNG | SEQ ID NO: 1546 |
| CGLFAELWGLLWHGLKNLIDWWNG | SEQ ID NO: 1547 |
| CGLFAELWGLLWHGLHNLLDWWNG | SEQ ID NO: 1548 |
| CGLFAELAELLWEGLKNLIDWWNG | SEQ ID NO: 1549 |
| CGLFAELAELLWHGLKNLIDWWNG | SEQ ID NO: 1550 |
| CGLFAELELLWQGLKNLIDWWNG | SEQ ID NO: 1551 |

TABLE 3-continued

Peptide Sequence Listing and ID

| Sequence | SEQ ID |
|---|---|
| CELFGELAGLLWHGLKNLIDWWNG | SEQ ID NO: 1552 |
| CLFEALWE-Aib-LEKLF | SEQ ID NO: 1553 |
| CFLEALWELLEHLL | SEQ ID NO: 1554 |
| CFLEALWKALEKLL | SEQ ID NO: 1555 |
| CGLF-Aib-EIAGLLEEGLHNLIDWWNG | SEQ ID NO: 1556 |
| CGLFGEI-Aib-GLLEEGLHNLIDWWNG | SEQ ID NO: 1557 |
| CGFFGEIAGLLEE-Aib-LHNLIDWWNG | SEQ ID NO: 1558 |
| CGLFGEIAGLLEEGLHNLIDWWN-Aib | SEQ ID NO: 1559 |
| CGLF-Aib-EIAGLLEE-Aib-LHNLIDWWNG | SEQ ID NO: 1560 |
| CGFFGEI-Aib-GLLEE-Aib-LHNLIDWWNG | SEQ ID NO: 1561 |
| CGFFGEI-Aib-ELIWEGLKNLIDWWNG | SEQ ID NO: 1562 |
| CGFFGEIAELIWELKNLIDWWN-Aib | SEQ ID NO: 1563 |
| CGFF Aib-EIAELIWE-Aib-LKNLIDWWNG | SEQ ID NO: 1564 |
| AC-CFLGALWKALSHLL | SEQ ID NO: 1565 |
| AC-CFLEELWELLEELLE | SEQ ID NO: 1566 |
| AC-CLFGALWKALSELL | SEQ ID NO: 1567 |
| AC-CGIGAVLKVLTTGLPALISWIKRKRQQ | SEQ ID NO: 1568 |
| AC-CGLFEAIEGFIENGWEGMIDGWYGYGRKKRRQRR | SEQ ID NO: 1569 |
| AC-CGLFEAIEGFIENGWEGMIDGWYGYGRKKRRQRRK(stearyl) | SEQ ID NO: 1570 |
| Ac-CFLGALWKALSHLL | SEQ ID NO: 1571 |
| Ac-CFLGALWKALSELL | SEQ ID No: 1572 |
| CELFEEIAELLWEGLENLIDWWNG | SEQ ID NO: 1573 |
| CGLFGEIAELIWEGLENLIDWWNG | SEQ ID NO: 1574 |
| CGLFGEIEELLEEGLENLIDWWNG | SEQ ID NO: 1575 |
| CGLFAELAELLWEGLENLIDWWNG | SEQ ID NO: 1576 |
| CGLFAELAELLEEGLENLIDWWNG | SEQ ID NO: 1577 |
| CGLFAELAELLWEGLENLIDWWNS | SEQ ID NO: 1578 |
| CGLFAELAELLEEGLENLIDWWNS | SEQ ID NO: 1579 |
| CGLFAELAELLWEGLENLIDWWNQ | SEQ ID NO: 1580 |
| CGLFAELAELLEEGLENLIDWWNQ | SEQ ID NO: 1581 |
| CGLFAELAELLWEGLENLIDWWNE | SEQ ID NO: 1582 |
| CGLFAELAELLEEGLENLIDWWNE | SEQ ID NO: 1583 |
| CELFEELAELLWEGLENLIDWWNQ | SEQ ID NO: 1584 |
| CELFEELAELLWEGLENLIDWWNE | SEQ ID NO: 1585 |
| CELFEELAELLEEGLENLIDWWNG | SEQ ID NO: 1586 |
| CELFAELAELLWEGLENLIDWWNG | SEQ ID NO: 1587 |
| CELFAELAELLEEGLENLIDWWNG | SEQ ID NO: 1588 |
| CELFAELAELLWEGLENLIDWWNS | SEQ ID NO: 1589 |

TABLE 3-continued

Peptide Sequence Listing and ID

| Sequence | SEQ ID |
|---|---|
| CELFAELAELLEEGLENLIDWWNS | SEQ ID NO: 1590 |
| CELFAELAELLWEGLENLIDWWNQ | SEQ ID NO: 1591 |
| CELFAELAELLEEGLENLIDWWNQ | SEQ ID NO: 1592 |
| CELFAELAELLWEGLENLIDWWNE | SEQ ID NO: 1593 |
| CELFAELAELLEEGLENLIDWWNE | SEQ ID NO: 1594 |
| CELFEELAELLWEGLHNLIDWWNG | SEQ ID NO: 1595 |
| CELFEELAELLWEGLHNLIDWWNS | SEQ ID NO: 1596 |
| CELFEELAELLWEGLHNLIDWWNQ | SEQ ID NO: 1597 |
| CELFEELAELLWEGLHNLIDWWNE | SEQ ID NO: 1598 |
| CELFGELEGFIENGLENLIDWWNG | SEQ ID NO: 1599 |
| CGLFEELEGFIENGLENLIDWWNG | SEQ ID NO: 1600 |
| CGLFAELAGFIENGLENLIDWWNG | SEQ ID NO: 1601 |
| CGLFAELEGFIENGLENLIDWWNG | SEQ ID NO: 1602 |
| CGLFGELAGFIENGLENLIDWWNG | SEQ ID NO: 1603 |
| CELFEELEGFIENGLENLIDWWNG | SEQ ID NO: 1604 |
| CELFAELAGFIENGLENLIDWWNG | SEQ ID NO: 1605 |
| CGLFGELEGFIWNGLENLIDWWNG | SEQ ID NO: 1606 |
| CGLFGELEGFIENGLENLIDWWNG | SEQ ID NO: 1607 |
| CGLFGELEGFIENGLENLIDWWNQ | SEQ ID NO: 1608 |
| CGLFGELEGFIENGLENLIDWWNE | SEQ ID NO: 1609 |
| CELFEELEGFIENGLENLIDWWNE | SEQ ID NO: 1610 |
| CGLLEEIAELLEEGLENLIDWWNS | SEQ ID NO: 1611 |
| CGLLEEIEELLWEGLENLIDWWNS | SEQ ID NO: 1612 |
| CELLEEIEELLEEGLENLIDWWNS | SEQ ID NO: 1613 |
| CGLLEEIAELLWEGLENLIDWWNS | SEQ ID NO: 1614 |
| CELLEEIAELLWEGLENLIDWWNS | SEQ ID NO: 1615 |
| CELLEEIEELLEEGLENLIDWWNE | SEQ ID NO: 1616 |
| CGLLEELEELLEEGLENLIDWWNS | SEQ ID NO: 1617 |
| CGLLEELEELLEEGLENLLEWWNS | SEQ ID NO: 1618 |
| CGLLEEIAELLEEGLENLIDWWNG | SEQ ID NO: 1619 |
| CGLLAEIAELLEEGLENLIDWWNS | SEQ ID NO: 1620 |
| CGLLAEIAELLWEGLENLIDWWNS | SEQ ID NO: 1621 |
| CGLLEEIEGFIENGLENLIDWWNS | SEQ ID NO: 1622 |
| CGLLEEIEGFIENGLENLIDWWNG | SEQ ID NO: 1623 |
| CGLLEEIEELLEEGLE-Cit-LIDWWNS | SEQ ID NO: 1624 |
| CGLLEEIEELLEQGLENLIDWWNS | SEQ ID NO: 1625 |
| CGLLAELAELLEEGLENLIDWWNS | SEQ ID NO: 1626 |
| CGLLEEIEELLEEGLENLIDWWNA | SEQ ID NO: 1627 |

TABLE 3-continued

Peptide Sequence Listing and ID

| Sequence | SEQ ID |
|---|---|
| CGLL-Aib-EIEELLEEGLENLIDWWNS | SEQ ID NO: 1628 |
| CGLLEEIEELLEEGLENLIDWWN-Aib | SEQ ID NO: 1629 |
| CGLLEEIEELLEE-Aib-LENLIDWWNG | SEQ ID NO: 1630 |
| CGLFGHIHHLIHHGLHNLIDWWNG | SEQ ID NO: 1631 |
| CGLFGEIHHLIHHGLHNLIDWWNG | SEQ ID NO: 1632 |
| CGLFGEIHHLIHHGLENLIDWWNG | SEQ ID NO: 1633 |
| CGLFGEIHELIHHGLENLIDWWNG | SEQ ID NO: 1634 |
| CELLEEIEELLEEGLENLIDWWNS | SEQ ID NO: 1635 |
| CGLFGELEELIEEGLENLIDWWNG | SEQ ID NO: 1636 |
| CGLLAEIEELLWEGLENLIDWWNS | SEQ ID NO: 1637 |
| CGLLEEIEELLEEGLENLLEWWNS | SEQ ID NO: 1638 |
| C(b-ALA)LLEEIEELLEEGLENLIDWWNS | SEQ ID NO: 1639 |
| CGLLEEIEELLEEGLENLIDLWNS | SEQ ID NO: 1640 |
| CGLLEEIEELLEWGLENLIDWWNS | SEQ ID NO: 1641 |
| CGLFGEIEELIEEGLENLIDWGNG | SEQ ID NO: 1642 |
| CGFFGEIAELIEEGLKNLIDWGNG | SEQ ID NO: 1643 |
| CGLFGEIEELIEEGLENLIDWANG | SEQ ID NO: 1644 |
| CGLFGEIEELIEEGLENLIDWSNG | SEQ ID NO: 1645 |
| CGLFGEIEELIEEGLENLIDW-(Aib)-NG | SEQ ID NO: 1646 |
| CGLFGEIEELIEEGLENLIDWPNG | SEQ ID NO: 1647 |
| CGLFGEIEELIEEGLENLIDWHNG | SEQ ID NO: 1648 |
| CGLFGEIEELIEEGLENLIDWQNG | SEQ ID NO: 1649 |
| CGLFGEIEELIEEGLENLIDWENG | SEQ ID NO: 1650 |
| CGLFEEIAELIEEGLENLIDWGNG | SEQ ID NO: 1651 |
| CELFEELAELLWEGLENLIDWGNS | SEQ ID NO: 1652 |
| CGLFGEIAELIWEGLENLIDWGNG | SEQ ID NO: 1653 |
| CGLLEEIEELLEEGLENLIDWGNS | SEQ ID NO: 1654 |
| CGLFAEIEELLEEGLENLIDWGNG | SEQ ID NO: 1655 |
| CGLL-(Aib)-EIEELLEEGLENLIDWWNS | SEQ ID NO: 1656 |
| CGLFGEIEELIEEGLENLIDWNNG | SEQ ID NO: 1657 |
| CGLFGEIEELIEEGLENLIDWDNG | SEQ ID NO: 1658 |
| CGLFGEIEELIEEGLENLIDWONG | SEQ ID NO: 1659 |
| CGLFAEIEELLEEGLENLIDWGNG | SEQ ID NO: 1660 |
| CGLL-Aib-EIEELLEEGLENLIDWGNS | SEQ ID NO: 1661 |
| CGLFGEIEELIEEGLENLIDGWNG | SEQ ID NO: 1662 |
| CGLFGEIEELIEEGLENLIDLWNG | SEQ ID NO: 1663 |
| CGWFGEIEELIEEGLENLIDWWNG | SEQ ID NO: 1664 |
| CGLFGEVEELIEEGLENLIDWWNG | SEQ ID NO: 1665 |

TABLE 3-continued

| Peptide Sequence Listing and ID | |
|---|---|
| Sequence | SEQ ID |
| CGLFGEIEEVIEEGLENLIDWWNG | SEQ ID NO: 1666 |
| CGLFGEIEELVEEGLENLIDWWNG | SEQ ID NO: 1667 |
| CGLFGEIEELAEEGLENLIDWWNG | SEQ ID NO: 1668 |
| CGLFGEIEELIDEGLENLIDWWNG | SEQ ID NO: 1669 |
| CGLFGEIEELIEDGLENLIDWWNG | SEQ ID NO: 1670 |
| CGLFGEIEELIEEGLEALIDWWNG | SEQ ID NO: 1671 |
| CGLFGEIEELIEEGLENIIDWWNG | SEQ ID NO: 1672 |
| CGLFGEIEELIEEGLEN-(Nle)-IDWWNG | SEQ ID NO: 1673 |
| CGLFGEIEELIEEGLENLIGWWNG | SEQ ID NO: 1674 |
| CGLFGEIEELIEEGLENLIDAWNG | SEQ ID NO: 1675 |
| CGLLEEIEELLEEGLENLIDWWNE | SEQ ID NO: 1676 |
| CELFEELAELLWEGLENLIDWWNE | SEQ ID NO: 1677 |
| CGLFGEIEELIEEGLENLIGWWNG | SEQ ID NO: 1678 |
| CGLFELIEGFIENGWEGMIDGWYGYGRKKRRQRR all (D) | SEQ ID NO: 1679 |
| CGLFEAIEGFIENGWEGMIDGWYG all (D) | SEQ ID NO: 1680 |
| CGLFGEIEELIENGLKNLIDWWYGYGRKKRRQRR all (D) | SEQ ID NO: 1681 |
| CGLFEALLELLESLWELLLEAYGRKKRRQRR all (D) | SEQ ID NO: 1682 |
| CGLFEEIEGFIENGWEGLIDWWYGYGHKKHHQHR all (D) | SEQ ID NO: 1683 |
| CGLFGEIEELIEEGLENLIDWWNE all (D) | SEQ ID NO: 1684 |
| CGLFGEIEELIEEGLENLIDWWNS all (D) | SEQ ID NO: 1685 |
| CGLFGEIEELIEEGLENLIDWWNQ all (D) | SEQ ID NO: 1686 |
| CYGRKKRRQRRLIRLWSHLIHIWFQNRRLKWKKK | SEQ ID NO: 1687 |
| CGLFEAIEEFIENGWEGMIDGWYGYGRKKRRQRR | SEQ ID NO: 1688 |
| CGLFFAIEGFIENGWEGMIDWWYGYGRKKRRQRR ALL (D) | SEQ ID NO: 1689 |
| CGLFELIEGFIENGWEGMIDGWYGYGRKKRRQRRK(STEARYL) ALL (D) | SEQ ID NO: 1690 |
| (STEARYL)GLFELIEGFIENGWEGMIDGWYGYGRKKRRQRRC ALL (D) | SEQ ID NO: 1691 |
| CFFGAIWEFIKSILK(STEARYL) ALL(D) | SEQ ID NO: 1692 |
| CGIFEAIAGLLKNIFKGIFEAIAGLLKNIFK ALL (D) | SEQ ID NO: 1693 |
| CIFGAIAGFIKNILKGLIDG ALL (D) | SEQ ID NO: 1694 |
| CGLFEAIEGFIENGWEGMIDGWYGYGRKKRRQRRK(STEARYL) ALL(D) | SEQ ID NO: 1695 |
| (LAURYL)FFGAIWEFIKSILC ALL (D) | SEQ ID NO: 1696 |

The D-amino acid, retro-inverso, and cysteine conjugation point variants of the peptides shown in Table 3 are also suitable.

The preferred peptides are listed in Table 4 below:

TABLE 4

Peptide Listing and ID

| Sequence | SEQ ID |
|---|---|
| CGLFEAIEGFIENGWEGMIDGWYGYGHKKHHQHH | SEQ ID NO: 2 |
| C-bAla-LFEAIEGFIENGWEGMIDGWYGYGRKKRRQRR | SEQ ID NO: 3 |
| CGLFEAIEGFIEWGWEGMIDGWYGYGRKKRRQRR | SEQ ID NO: 5 |
| CGLFEAIEGFIENGWEGMIDGWYGYGRKKRRQR | SEQ ID NO: 7 |
| CGLFHALLHLLHSLWHGLLHAWYGYGHKKHHQHR | SEQ ID NO: 11 |
| CGLFELIEGFIENGWEGMIDGWYGYGRKKRRQRR | SEQ ID NO: 13 |
| CGLFEAIEGFIENGWEG-Nle-IDGWYGYGRKKRRQRR | SEQ ID NO: 19 |
| CGLLEALEGLLESLWEGLLEAWYGYGRKKRRQRR | SEQ ID NO: 22 |
| CGLFEAIEGFIENGWEGMIDGWYGYGRKKRRQRRK(stearyl) | SEQ ID NO: 27 |
| CGLFEAIAGFIEGGWPGLINGWYGYGRKKRRQRRLHLLHHLLHHLHHL LHHLLHLLHHLLHHL | SEQ ID NO: 28 |
| CGLFEAIEGFIENGWEGMIDGWYGGGGLHLLHHLLHHLHHLLHHLLHL LHHLLHHL | SEQ ID NO: 29 |
| CGLFEAIEGFIENGWEGMIDGWYGLHLLHHLLHHLHHLLHHLLHL | SEQ ID NO: 30 |
| CGLFEALLELLESLWELLLEAYGRKKRRQRR | SEQ ID NO: 31 |
| CGLFEAIEGFIENGWEGMIDGWYGYGRKKRRQRR | SEQ ID NO: 32 |
| CGLFHALLHLLHSLWHLLLHAWYGYGRKKRRQRR | SEQ ID NO: 55 |
| CGLFHALLHLLHSLWHLLLHAWYGYGHKKHHQHR | SEQ ID NO: 56 |
| CGIFGAIAGLLKNIFK | SEQ ID NO: 63 |
| CIFGAIAGFIKNIWKGLIDW | SEQ ID NO: 64 |
| stearyl-WEAALAEALAEALAEHLAEALAEALEALAAYGRKKRRQRRC | SEQ ID NO: 69 |
| CGFFHAFFHFFHSFWHGFFEA | SEQ ID NO: 71 |
| CGNFGEIEELIEEGLENLIDWWNG | SEQ ID NO: 72 |
| CFFGAIWEFIRNILEGF | SEQ ID NO: 73 |
| CFFGAIWEFIHSIL | SEQ ID NO: 74 |
| CGLFGEIEEFIENGWKGLIDWWYG | SEQ ID NO: 86 |
| CIFGIDDLIIGLLFVAIVEAGIGGYLLGSYGRKKRRQRR | SEQ ID NO: 90 |
| CFFGAIWEFIRSILK | SEQ ID NO: 94 |
| CFFGAIWEFIRSILE | SEQ ID NO: 95 |
| CGLFEAIEGFIENGWEGMIDWWYGYGRKKRRQRR | SEQ ID NO: 106 |
| CGLFEAIEGFIENGWEGMIDGWYGYGRKKRRQRR all (D) | SEQ ID NO: 137 |
| CRRQRRKKRGYGYWGDIMGEWGNEIFGEIAEFLG | SEQ ID NO: 192 |
| RRQRRKKRGYGYWGDIMGEWGNEIFGEIAEFLGC all(D) | SEQ ID NO: 200 |
| CRRQRRKKRGYGYWGDIMGEWGNEIFGEIAEFLG all(D) | SEQ ID NO: 201 |
| CGLFEAIEGFIENGWKGMIDGWYGYGRKKRRQRR | SEQ ID NO: 228 |
| CGLFEAIEGFIENGWKGMIDGWYGYGRKKRRQRR | SEQ ID NO: 228 |
| CGLFEAIEGFIENGWKGLIDWWYGYGRKKRRQRRK (stearyl) | SEQ ID NO: 266 |

TABLE 4-continued

Peptide Listing and ID

| Sequence | SEQ ID |
|---|---|
| CIFGAIAGFIKNIW | SEQ ID NO: 283 |
| CFFGAIWEFIRNIL | SEQ ID NO: 333 |
| FFGAIWEFIKSILC | SEQ ID NO: 409 |
| CFFGKIWEFIKSIL | SEQ ID NO: 407 |
| CFFGAIWEFAKSIL | SEQ ID NO: 423 |
| CGLFHALLHLLHSLWHLLLEA | SEQ ID NO: 436 |
| CGLFHALLHLLHSLWKLLLEW | SEQ ID NO: 437 |
| CGFFGEIAELIEEGLKGLIDWWNG | SEQ ID NO: 461 |
| CGLFGEIEELIEEGLENLIDWWNG | SEQ ID NO: 462 |
| CFFGAIWEFIHSIL all (D) | SEQ ID NO: 463 |
| CGIFEAIAGLLKSILKK(stearyl) | SEQ ID NO: 468 |
| CGIFGAIAGLLKSILKK(stearyl) | SEQ ID NO: 469 |
| CIFGAIAGFIKNILKGL all (D) | SEQ ID NO: 470 |
| CIFGAIAGFIKNILKGLK(stearyl) | SEQ ID NO: 473 |
| GLGKLINKIFGAIAGFIC all (D) | SEQ ID NO: 474 |
| CGLFGEIEELIEEGLENLIDWWNG all(D) | SEQ ID NO: 491 |
| CGNFGEIEELIEEGLENLIDWWNG all(D) | SEQ ID NO: 492 |
| CGFFGEIAELIEEGLKGLIDWWNG all(D) | SEQ ID NO: 493 |
| CGIFEAIAGLLKNIFK all(D) | SEQ ID NO: 612 |
| CIFGAIAGFIKNIWEGLI all (D) | SEQ ID NO: 489 |
| CGLFGEIEELIEEGLENLIDWGNG all (D) | SEQ ID NO: 1074 |
| CGLFGEIEELIEEGLENLIDWGNG | SEQ ID NO: 1642 |
| CGLFELIEGFIENGWEGMIDGWYGYGRKKRRQRR all (D) | SEQ ID NO: 1679 |
| CGLFEAIEGFIENGWEGMIDGWYG all (D) | SEQ ID NO: 1680 |
| CGLFGEIEELIENGLKNLIDWWYGYGRKKRRQRR all (D) | SEQ ID NO: 1681 |
| CGLFEALLELLESLWELLLEAYGRKKRRQRR all (D) | SEQ ID NO: 1682 |
| CGLFEEIEGFIENGWEGLIDWWYGYGHKKHHQHR all (D) | SEQ ID NO: 1683 |
| CGLFGEIEELIEEGLENLIDWWNE all (D) | SEQ ID NO: 1684 |
| CGLFGEIEELIEEGLENLIDWWNS all (D) | SEQ ID NO: 1685 |
| CGLFGEIEELIEEGLENLIDWWNQ all (D) | SEQ ID NO: 1686 |
| GFFGAIWEFIKSILC | SEQ ID NO: 337 |

The D-amino acid, retro-inverso, and cysteine conjugation point variants of the peptides shown in Table 4 are also preferred.

Targeting Ligands

The modular compositions of the present invention may comprise a targeting ligand. In some embodiments, this targeting ligand may direct the modular composition to a particular cell. For example, the targeting ligand may specifically or non-specifically bind with a molecule on the surface of a target cell. The targeting moiety can be a molecule with a specific affinity for a target cell. Targeting moieties can include antibodies directed against a protein found on the surface of a target cell, or the ligand or a receptor-binding portion of a ligand for a molecule found on the surface of a target cell. Examples and a further description of targeting ligands can be found in WO2009/126933, which is hereby incorporated by reference.

The targeting ligands are selected from the group consisting of an antibody, a ligand-binding portion of a receptor, a ligand for a receptor, an aptamer, D-galactose, N-acetyl-D-galactose (GalNAc), multivalent N-acetyl-D-galactose, D-mannose, cholesterol, a fatty acid, a lipoprotein, folate, thyrotropin, melanotropin, surfactant protein A, mucin, carbohydrate, multivalent lactose, multivalent galactose, N-acetyl-galactosamine, N-acetyl-glucosamine, multivalent mannose, multivalent fructose, glycosylated polyaminoacids, transferrin, bisphosphonate, polyglutamate, polyaspartate, a lipophilic moiety that enhances plasma protein binding, a steroid, bile acid, vitamin B12, biotin, an RGD peptide, an RGD peptide mimic, ibuprofen, naproxen, aspirin, folate, and analogs and derivatives thereof.

The preferred targeting ligands are selected from the group consisting of D-galactose, N-acetyl-D-galactose (GalNAc), GalNAc2, and GalNAc3, cholesterol, folate, and analogs and derivatives thereof.

Lipids

Lipophilic moieties, such as cholesterol or fatty acids, when attached to highly hydrophilic molecules such as nucleic acids can substantially enhance plasma protein binding and consequently circulation half life. In addition, lipophilic groups can increase cellular uptake. For example, lipids can bind to certain plasma proteins, such as lipoproteins, which have consequently been shown to increase uptake in specific tissues expressing the corresponding lipoprotein receptors (e.g., LDL-receptor or the scavenger receptor SR-B1). Lipophilic conjugates can also be considered as a targeted delivery approach and their intracellular trafficking could potentially be further improved by the combination with endosomolytic agents.

Exemplary lipophilic moieties that enhance plasma protein binding include, but are not limited to, sterols, cholesterol, fatty acids, cholic acid, lithocholic acid, dialkylglycerides, diacylglyceride, phospholipids, sphingolipids, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, phenoxazine, aspirin, naproxen, ibuprofen, vitamin E and biotin etc. Examples and a further description of lipids can be found in WO2009/126933, which is hereby incorporated by reference.

The preferred lipid is cholesterol.

Solubilizing Agents

The modular composition may comprise one or more other moieties/ligands that may enhance aqueous solubility, circulation half life and/or cellular uptake. These can include naturally occurring substances, such as a protein (e.g., human serum albumin (HSA), low-density lipoprotein (LDL), high-density lipoprotein (HDL), or globulin); or a carbohydrate (e.g, a dextran, pullulan, chitin, chitosan, inulin, cyclodextrin or hyaluronic acid). These moieties may also be a recombinant or synthetic molecule, such as a synthetic polymer or synthetic polyamino acids. Examples include polylysine (PLL), poly L-aspartic acid, poly L-glutamic acid, styrene-maleic acid anhydride copolymer, poly (L-lactide-co-glycolied) copolymer, divinyl ether-maleic anhydride copolymer, N-(2-hydroxypropyl)methacrylamide copolymer (HMPA), polyethylene glycol (PEG, e.g., PEG-0.5K, PEG-2K, PEG-5K, PEG-10K, PEG-12K, PEG-15K, PEG-20K, PEG-40K), methyl-PEG (mPEG), [mPEG]2, polyvinyl alcohol (PVA), polyurethane, poly(2 ethylacryllic acid), N-isopropylacrylamide polymers, or polyphosphazine. Examples and a further description of solubilizing agents can be found in WO2009/126933, which is hereby incorporated by reference.

The preferred solubilizing group is PEG 0.5K to 30K.

Method of Treatment

In one aspect, the invention features, a method of treating a subject at risk for or afflicted with a disease that may benefit from the administration of the modular composition of the invention. The method comprises administering the modular composition of the invention to a subject in need thereof, thereby treating the subject. The oligonucleotide that is administered will depend on the disease being treated. See WO2009/126933 for additional details regarding methods of treatments for specific indications.

Formulation

There are numerous methods for preparing conjugates of oligonucleotide compounds. The techniques should be familiar to those skilled in the art. A useful reference for such reactions is Bioconjugate Techniques, Hermanson, G. T., Academic Press, San Diego, Calif., 1996. Other references include WO2005/041859; WO2008/036825 and WO2009/126933.

EXAMPLES

The invention is further illustrated by the following examples, which should not be construed as further limiting. The contents of all references, pending patent applications and published patents, cited throughout this application are hereby expressly incorporated by reference. The siRNAs described herein were designed to target the ubiquitously expressesd gene SSB (Sjogren syndrome antigen B; NM_009278.4).

Linker groups may be connected to the oligonucleotide or siRNA strand(s) at a linkage attachment point (LAP) and may include any carbon-containing moiety, in some embodiments having at least one oxygen atom, at least one phosphorous atom, and/or at least one nitrogen atom. In some embodiments, the phosphorous atom forms part of a terminal phosphate, or phosphorothioate, group on the linker group, which may serve as a connection point for the oligonucleotide strand. In certain embodiments, the nitrogen atom forms part of a terminal ether, ester, amino or amido (NHC(O)—) group on the linker group, which may serve as a connection point for the linkers of interest, endosomolytic unit, cell penetrating peptide, solubilizing group, lipid, targeting group, or additional linkers of interest. These terminal linker groups include, but are not limited to, a $C_6$ hexyl, $C_5$ secondary-hydroxy, $C_3$ thiol or $C_6$ thiol moiety. An example from the RNA sequences described below is C6 hexyl: [$(CH_2)_6$ $NH_2$].

The siRNA sequences described in the Examples herein are shown in Table 5.

TABLE 5

| Entry | Sequence Code | Compound | strand | Sequence | SEQ ID NO: |
|---|---|---|---|---|---|
| 1 | b | CTNNB1 | passenger | [6amiL][iB][omeC][omeU][clickG][omeU][omeU][fluG][fluG][fluA][omeU][omeU][fluG][fluA][omeU][omeU][omeC][fluG][clickA][fluA][fluA][omeUs][omeU][iB][C3SH] | 1697 |

TABLE 5-continued

| Entry | Sequence Code | Compound | strand | Sequence | SEQ ID NO: |
|---|---|---|---|---|---|
| | | CTNNB1 | guide | [omeUs][fluUs][omeUs][fluC][omeG][fluA][omeA][fluU][omeC][fluA][omeA][fluU][omeC][fluC][omeA][fluA][omeC][fluA][omeG][omeUs][omeU] | 1698 |
| 2 | c | ApoB | passenger | [C6SH][iB][omeC][omeU][omeU][omeU][fluA][fluA][omeC][fluA][fluA][omeU][omeU][omeC][omeC][fluG][fluA][fluA][fluA][omeU][dTs]dT[iB][6amiL] | 1699 |
| | | ApoB | guide | [rAs][rUs][rUs][omeU][omeC][fluA][fluG][fluG][fluA][fluA][omeU][omeU][fluG][fluU][omeU][fluA][fluA][fluA][fluG][omeUs][omeU] | 1700 |
| 3 | d | CTNNB1 | passenger | [6amiL][iB][omeC][omeU][clickG][omeU][omeU][fluG][fluG][fluA][omeU][omeU][fluG][fluA][omeU][omeU][omeC][fluG][clickA][fluA][fluA][omeUs][omeU][iB][C3SH] | 1701 |
| | | CTNNB1 | guide | [omeUs][fluUs][omeUs][fluC][omeG][fluA][omeA][fluU][omeC][fluA][omeA][fluU][omeC][fluC][omeA][fluA][omeC][fluA][omeG][omeUs][omeU] | 1702 |
| 4 | e | CTNNB1 | passenger | [6amiL][iB][omeC][omeU][omeU][omeU][fluG][fluG][fluA][omeU][omeU][fluG][fluA][omeU][omeU][omeC][fluG][clickA][fluA][fluA][omeUs][omeU][iB][C3SH] | 1703 |
| | | CTNNB1 | guide | [omeUs][fluUs][omeUs][fluC][omeG][fluA][omeA][fluU][omeC][fluA][omeA][fluU][omeC][fluC][omeA][fluA][omeC][fluA][omeG][omeUs][omeU] | 1704 |
| 5 | f | CTNNB1 | passenger | [6amiL][iB][omeC][omeU][clickG][omeU][omeU][fluG][fluG][fluA][omeU][omeU][fluG][fluA][clickU][omeU][omeC][fluG][fluA][clickA][fluA][omeUs][omeU][iB][C3SHSup] | 1705 |
| | | CTNNB1 | guide | [omeUs][fluUs][omeUs][fluC][omeG][fluA][omeA][fluU][omeC][fluA][omeA][fluU][omeC][fluC][omeA][fluA][omeC][fluA][omeG][omeUs][omeU] | 1706 |
| 6 | g | CTNNB1 | passenger | [6amiL][iB][omeC][omeU][clickG][omeU][omeU][fluG][fluG][clickA][omeU][omeU][fluG][fluA][clickU][omeU][omeC][fluG][fluA][clickA][fluA][omeUs][omeU][iB][C3SHSup] | 1707 |
| | | CTNNB1 | guide | [omeUs][fluUs][omeUs][fluC][omeG][fluA][omeA][fluU][omeC][fluA][omeA][fluU][omeC][fluC][omeA][fluA][omeC][fluA][omeG][omeUs][omeU] | 1708 |
| 7 | h | CTNNB1 | passenger | [LiCholinker][iB][omeC][omeU][fluG][omeU][omeU][fluG][fluG][fluA][omeU][omeU][fluG][fluA][omeU][omeU][omeC][fluG][fluA][fluA][fluA][omeUs][omeU][iB][6amiL] | 1709 |
| | | CTNNB1 | guide | [omeUs][fluUs][omeUs][fluC][omeG][fluA][omeA][fluU][omeC][fluA][omeA][fluU][omeC][fluC][omeA][fluA][omeC][fluA][omeG][omeUs][omeU] | 1710 |
| 8 | i | CTNNB1 | passenger | [amino modifier C2dT][iB][omeC][omeU][clickG][omeU][omeU][fluG][fluG][fluA][omeU][omeU][fluG][fluA][omeU][omeU][omeC][fluG][clickA][fluA][fluA][omeUs][omeU][iB][C3SSC3OH] | 1711 |
| | | CTNNB1 | guide | [omeUs][fluUs][omeUs][fluC][omeG][fluA][omeA][fluU][omeC][fluA][omeA][fluU][omeC][fluC][omeA][fluA][omeC][fluA][omeG][omeUs][omeU] | 1712 |
| 9 | j | CTNNB1 | passenger | [6amiL][iB][omeC][omeU][clickG][omeU][omeU][fluG][fluG][fluA][omeU][omeU][fluG][fluA][omeU][omeU][omeC][fluG][fluA][fluA][fluA][omeUs][omeU][iB][C3SH] | 1713 |
| | | CTNNB1 | guide | [omeUs][fluUs][omeUs][fluC][omeG][fluA][omeA][fluU][omeC][clickA][omeA][fluU][omeC][fluC][clickA][fluA][omeC][fluA][omeG][omeUs][omeUSup] | 1714 |
| 10 | k | CTNNB1 | passenger | [6amiL][iB][omeC][omeU][clickG][omeU][omeU][fluG][fluG][fluA][omeU][omeU][fluG][fluA][omeU][omeU][omeC][fluG][fluA][fluA][fluA][omeUs][omeU][iB][C3SH] | 1715 |
| | | CTNNB1 | guide | [omeUs][fluUs][omeUs][fluC][omeG][fluA][omeA][fluU][omeC][fluA][omeA][fluU][omeC][fluC][clickA][fluA][omeC][fluA][omeG][omeUs][omeU] | 1716 |
| 11 | l | CTNNB1 | passenger | [6amiL][iB][omeC][omeU][fluG][omeU][omeU][fluG][fluG][fluA][omeU][omeU][fluG][fluA][omeU][omeU][omeC][fluG][fluA][fluA][fluA][omeUs][omeU][iB][6amiL] | 1717 |
| | | CTNNB1 | guide | [omeUs][fluUs][omeUs][fluC][omeG][fluA][omeA][fluU][omeC][fluA][omeA][fluU][omeC][fluC][clickA][fluA][omeC][fluA][omeG][omeUs][omeU] | 1718 |
| 12 | m | CTNNB1 | passenger | [6amiL][iB][omeC][omeU][clickG][omeU][omeU][fluG][fluG][fluA][omeU][omeU][fluG][fluA][clickU][omeU][omeC][fluG][fluA][clickA][fluA][omeUs][omeU][iB][C3SHSup] | 1719 |
| | | CTNNB1 | guide | [omeUs][fluUs][omeUs][fluC][omeG][fluA][omeA][fluU][omeC][fluA][omeA][fluU][omeC][fluC][clickA][fluA][omeC][fluA][omeG][omeUs][omeU] | 1720 |

As used herein, ome = 2' methoxy; flu = 2' fluoro; click = 2' propargyl; iB = inverted abasic; "s" subscript = phosphorothioate; and r = 2' ribo; 6amil = n-hexylamino; C3SH = n-propylthiol; and C6SH = n-hexylthiol.

Preparations of tetraGalNAc ligands and tetraGalNAc-siRNA conjugates are described below in the examples and synthetic schemes. Note that the siRNA depictions below are for illustrative purposes. Specific sequence information can be found in Table 5.

Section A

Examples 1-2

Synthesis of TetraGalNAc Ligand Compounds A9 and A10

The following Scheme 1 was used to prepare TetraGal-NAc Compounds 9 and 10.

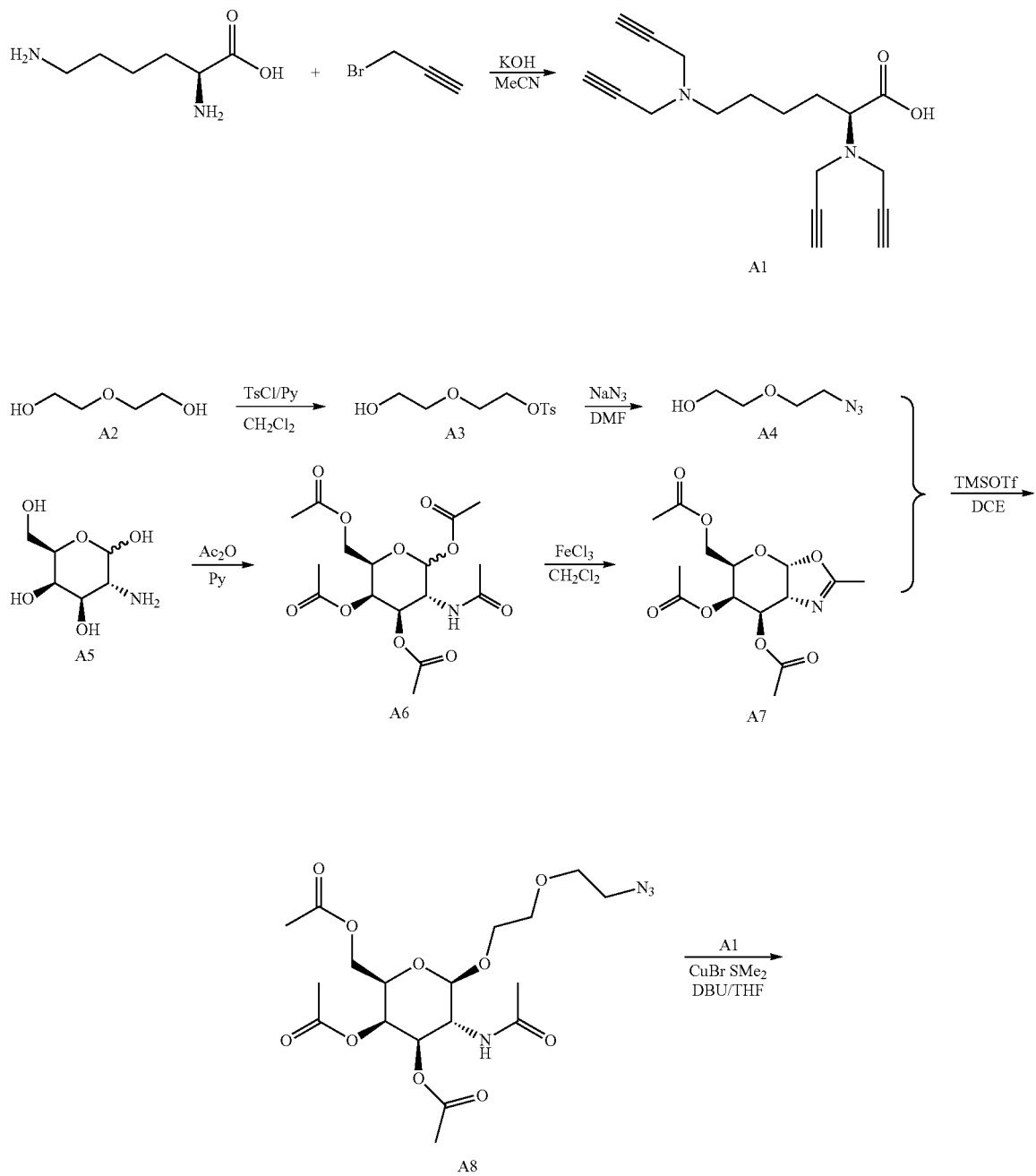

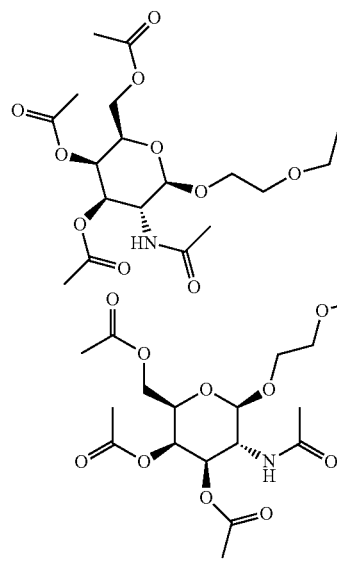
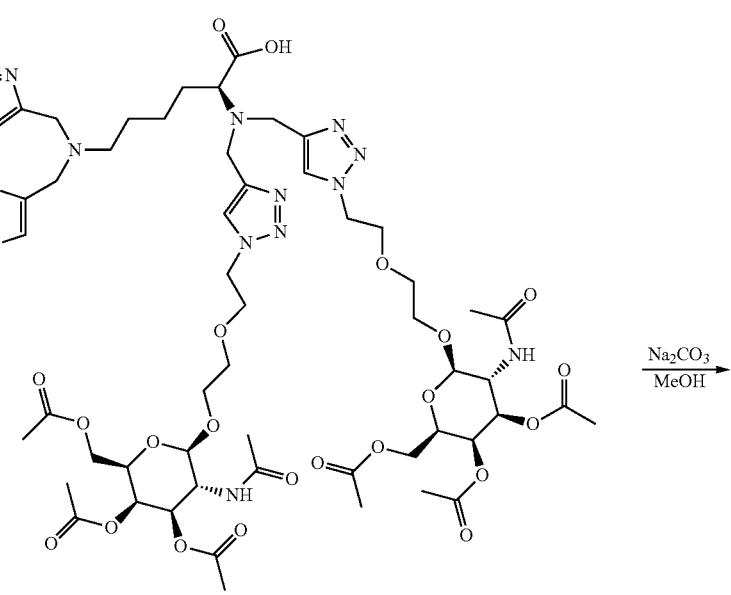

A9

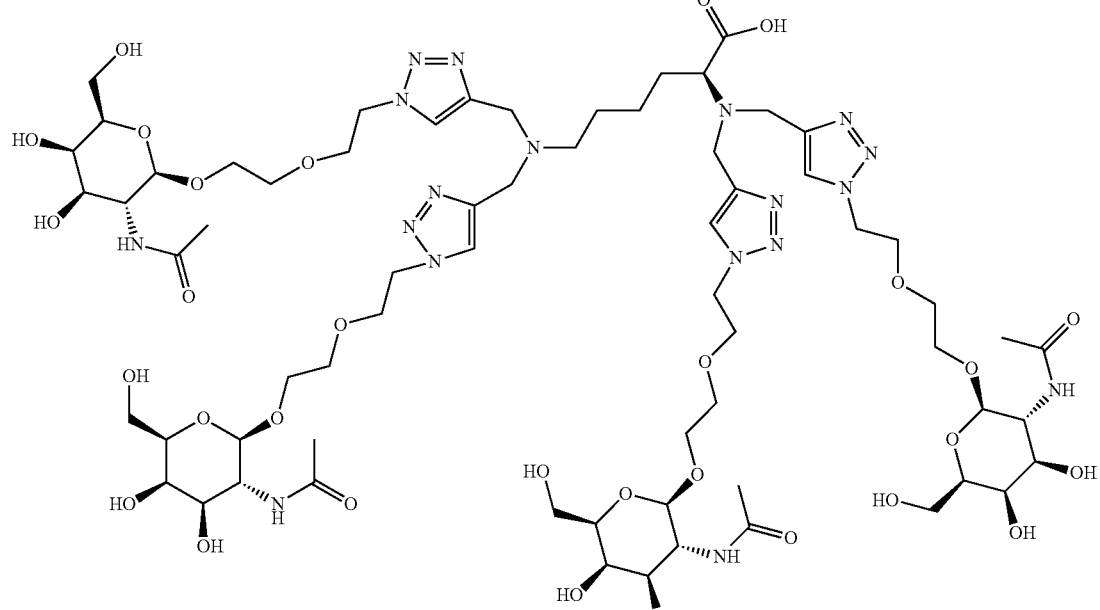

A10

Synthesis of (2S)-2,6-bis[bis (prop-2-yn-1-yl)amino]hexanoic acid (Compound A1)

Into a 2000-mL 3-necked round-bottom flask purged and maintained with an inert atmosphere of nitrogen was placed a solution of (2S)-2,6-diaminohexanoic acid (50 g, 342.03 mmol, 1.00 equiv) in acetonitrile (1000 mL) and heated to 50° C. To this was added potassium hydroxide (22.6 g, 0.4025 mol, 1.00 equiv, 85%). The resulting solution was stirred for 30 min. Then 3-bromoprop-1-yne (29.5 mL, 1.00 equiv) was added. The resulting solution was stirred for 1 hour at 50° C. additional potassium hydroxide (22.6 g, 0.4025 mol, 1.00 equiv) was added to the solution and stirred for 30 min at 50° C. To this was added 3-bromoprop-1-yne (29.5 mL, 1.00 equiv). The resulting solution was stirred for 1 hour. To this was added potassium hydroxide (22.6 g, 0.4025 mol, 1.00 equiv) again. The resulting solution was stirred for 30 min at 50° C., followed by addition of more 3-bromoprop-1-yne (29.5 mL, 1.00 equiv). The resulting solution was stirred for 1 hour. To this was added potassium hydroxide (22.6 g, 0.4025 mol, 1.00 equiv). The resulting solution was stirred for 30 min. To this was added 3-bromoprop-1-yne (29.5 mL, 1.00 equiv). The resulting solution was stirred for 3 hours. The reaction mixture was cooled to 25° C. with a water/ice bath. The solid was filtered out. The filtrate was adjusted to pH 4 with HCl (6M). The solid was filtered out. The filtrate was concentrated under vacuum. The residue was applied onto a silica gel column and eluted with dichloromethane/methanol (100:1-25:1).

This resulted in (2S)-2,6-bis[bis (prop-2-yn-1-yl)amino]hexanoic acid (Compound A1) as a light yellow oil.

MS(ES, m/z): 297.2, [M−H]⁻ ¹HNMR(CDCl₃, 500 MHz, ppm): 3.62 (d, J=2.0 Hz, 4H), 3.52-3.49 (m, 1H), 3.50 (d, J=2.4 Hz, 4H), 2.62 (t, J=7.1 Hz, 2H), 2.30 (t, J=2.4 Hz, 2H), 2.27 (t, J=2.4 Hz, 2H), 1.88-1.79 (m, 2H), 1.60-1.53 (m, 2H), 1.52-1.43 (m, 2H).

Synthesis of 2-(2-hydroxyethoxyl)ethyl 4-methylbenzenesulfonate (Compound A3)

Into a 2000-mL 3-necked round-bottom flask purged and maintained with an inert atmosphere of nitrogen was placed a solution of 2-(2-hydroxyethoxyl)ethan-1-ol (A2, 42.4 g, 399.55 mmol, 1.00 equiv) in dichloromethane (1000 mL) and triethylamine (27.9 g, 275.72 mmol, 0.25 equiv). To the above was added p-toluenesulfonyl chloride (19.1 g, 100.18 mmol, 0.50 equiv). After stirred for 1 h at 25° C., the resulting mixture was washed with 1×500 mL of aq. potassium hydrosulfate (1M) and 1×500 mL of aq. sodium bicarbonate (5%) respectively. The organic layer was dried over anhydrous sodium sulfate and concentrated under vacuum. The residue was applied onto a silica gel column and eluted with dichloromethane/methanol (100:1). This resulted in 2-(2-hydroxyethoxyl)ethyl 4-methylbenzenesulfonate (Compound A3) as a colorless oil.

Synthesis of 2-(2-azidoethoxyl)ethan-1-ol (Compound A4)

Into a 500-mL round-bottom flask purged and maintained with an inert atmosphere of nitrogen was placed a solution of 2-(2-[[(4-2-(2-hydroxyethoxyl)ethyl 4-methylbenzenesulfonate (A3, 50 g, 192.08 mmol, 1.00 equiv) in N,N-dimethylformamide (250 mL). This was followed by the addition of sodium azide (18.79 g, 289.03 mmol, 1.50 equiv) at 25° C. The resulting solution was stirred for 5 h at 100° C. in an oil bath. The reaction mixture was cooled and filtered. The filtrate was concentrated under vacuum. The residual solution was diluted with 1000 mL of dichloromethane and washed with 1×500 mL of water. The organic layer was dried over anhydrous sodium sulfate and concentrated under vacuum. The residue was applied onto a silica gel column and eluted with dichloromethane/methanol (80:1). This resulted in 2-(2-azidoethoxyl)ethan-1-ol (Compound A4) as a colorless oil.

¹HNMR (CDCl₃, 400 MHz, ppm): 3.42-3.45 (t, J=4.8 Hz, 2H), 3.63-3.65 (t, J=4.8 Hz, 2H), 3.71-3.74 (t, J=4.8 Hz, 2H), 3.71-3.79 (m, 2H).

Synthesis of (3R,4R,5R,6R)-3-acetamido-6-(acetoxymethyl)tetrahydro-2H-pyran-2,4,5-triyl triacetate (Compound A6)

Into a 2000-mL 3-necked round-bottom flask purged and maintained with an inert atmosphere of nitrogen was placed a solution of (3R,4R,5R,6R)-3-amino-6-(hydroxymethyl)tetrahydro-2H-pyran-2,4,5-triol hydrochloride (A5, 120 g, 556.50 mmol, 1.00 equiv) in pyridine (1200 mL). This was followed by the addition of acetic anhydride (341.6 g, 3.35 mol, 6.00 equiv) dropwise with stirring at 0° C. The resulting solution was stirred overnight at 25° C. The reaction was then quenched by the addition of 8000 mL of water/ice. The solid was collected by filtration. This resulted in (3R,4R,5R,6R)-3-acetamido-6-(acetoxymethyl)tetrahydro-2H-pyran-2,4,5-triyl triacetate (Compound A6) as a white solid.

Synthesis of (3aR,5R,6R,7R,7aR)-5-(acetoxymethyl)-2-methyl-5,6,7,7a-tetrahydro-3aH-pyrano[3,2-d]oxazole-6,7-diyl diacetate (Compound A7)

Into a 2000-mL round-bottom flask purged and maintained with an inert atmosphere of nitrogen was placed a solution of (3R,4R,5R,6R)-3-acetamido-6-(acetoxymethyl)tetrahydro-2H-pyran-2,4,5-triyl triacetate (A6, 30 g, 77.05 mmol, 1.00 equiv) in dichloromethane (1500 mL), then added iron (III) chloride (30 g, 184.95 mmol, 2.40 equiv). The resulting mixture was stirred for 2 h at 25° C. The reaction was then quenched by the addition of 1000 mL of water/ice. The organic layer was washed with 1×1000 mL of sodium aq. bicarbonate and 1×1000 mL of water, dried over anhydrous sodium sulfate and concentrated under vacuum. This resulted in (3aR,5R,6R,7R,7aR)-5-(acetoxymethyl)-2-methyl-5,6,7,7a-tetrahydro-3aH-pyrano[3,2-d]oxazole-6,7-diyl diacetate (Compound A7) as yellow oil.

¹HNMR(CDCl₃, 300 MHz, ppm): 2.03 (s, 9H), 2.12 (s, 3H), 3.97-4.27 (m, 4H), 4.90-4.93 (m, J=3.3 Hz, 1H), 5.45-5.47 (t, J=3.0 Hz, 1H), 5.98-6.00 (d, J=6.6 Hz, 1H).

Synthesis of (2R,3R,4R,5R,6R)-5-acetamido-2-(acetoxymethyl)-6-[2-(2-azidoethoxyl)ethoxy]tetrahydro-2H-pyran-3,4-diyl diacetate (Compound A8)

Into a 500-mL round-bottom flask purged and maintained with an inert atmosphere of nitrogen was placed a solution of (3aR,5R,6R,7R,7aR)-5-(acetoxymethyl)-2-methyl-5,6,7,7a-tetrahydro-3aH-pyrano[3,2-d]oxazole-6,7-diyl diacetate (A7, 40 g, 121.47 mmol, 1.00 equiv) in 1,2-dichloroethane (200 mL), 2-(2-azidoethoxyl)ethan-1-ol (A4, 23.89 g, 182.18 mmol, 1.50 equiv). To the above several 4A zeolite was added. The resulting mixture was stirred for 1 h at 25° C. Then trimethylsilyl trifluoromethanesulfonate (10.8 mL, 0.50 equiv) was added. After stirred overnight at 25° C., the reaction mixture was diluted with 500 mL of dichloromethane and washed with 1×500 mL of water, 1×500 mL of aq. sodium bicarbonate and 1×500 mL of water. The organic layer was dried over anhydrous sodium sulfate and concentrated under vacuum. The residue was applied onto a silica gel column and eluted with dichloromethane/methanol (100:1). This resulted in (2R,3R,4R,5R,6R)-5-acetamido-2-(acetoxymethyl)-6-[2-(2-azidoethoxyl)ethoxy]tetrahydro-2H-pyran-3,4-diyl diacetate (A8) as a colorless oil.

MS(m/z): 461.1, [M+H]⁺
¹HNMR(CDCl₃, 500 MHz, ppm) 5.78 (d, J=8.90 Hz, 1H), 5.36 (d, J=2.9 Hz, 1H), 5.22 (dd, J=11.2, 3.6 Hz, 1H), 4.77 (d, J=8.3 Hz, 1H), 4.19-4.12 (m, 2H), 4.11-4.05 (m, 1H), 3.98-3.92 (m, 2H), 3.82-3.78 (m, 1H), 3.71-3.63 (m, 4H), 3.49-3.38 (m, 2H), 2.16 (s, 3H), 2.05 (s, 3H), 2.01 (s, 3H), 1.97 (s, 3H).

Synthesis of (S)-2,6-bis(bis((1-(2-(2-(((2R,3R,4R,5R,6R)-3-acetamido-4,5-diacetoxy-6-(acetoxymethyl)tetrahydro-2H-pyran-2-yl)oxy)ethoxy)ethyl)-1H-1,2,3-triazol-4-yl)methyl)amino)hexanoic acid (Compound A9, tetraGalNAc Acetate) (A9) (Ex. 1)

Into a 250-mL round bottom flask purged and maintained with an inert atmosphere of nitrogen was charged (2S)-2,6-bis [bis (prop-2-yn-1-yl)amino]hexanoic acid (A1, 1.0 g, 1.0 equiv), (2R,3R,4R,5R,6R)-5-acetamido-2-(acetoxymethyl)-6-[2-(2-azidoethoxyl)ethoxy]tetrahydro-2H-pyran-3,4-diyl diacetate (A8, 9.26 g, 6.0 equiv), anhydrous THF 50 mL, CuBr.SMe₂ (0.138 g, 0.20 equiv), and anhydrous DBU (1.5 ml, 3.0 equiv) in respective order. The resulting solution was stirred for 16 h at room temperature, quenched with acetic acid (0.75 mL, 4.0 equiv), treated with MP-TMT resin (Part No: 801472, from Biotage) (9 g), aged at room temperature for 16 h, filtered, and concentrated the filtrate to a foam solid. The solid was then dissolved in $CH_2Cl_2$ (140 mL), and washed with AcOH/NaCl solution (140 mL). The AcOH/NaCl solution was prepared with 1 mL AcOH and 100 mL 20% NaCl solution. The bottom organic layer was concentrated, and purified on a $SiO_2$ column (220 g), eluting with $CH_2Cl_2$/MeOH. This resulted in (S)-2,6-bis(bis((1-(2-(2-(((2R,3R,4R,5R,6R)-3-acetamido-4,5-diacetoxy-6-(acetoxymethyl)tetrahydro-2H-pyran-2-yl)oxy)ethoxy)ethyl)-1H-1,2,3-triazol-4-yl)methyl)amino)hexanoic acid (Compound A9) as a white solid.

MS(m/z): 2139.5, $[M+H]^+$

Synthesis of (S)-2,6-bis(bis((1-(2-(2-(((2R,3R,4R,5R,6R)-3-acetamido-4,5-dihydroxy-6-(hydroxymethyl)tetrahydro-2H-pyran-2-yl)oxy)ethoxy)ethyl-1H-123-triazol-4-yl)methyl)amino)hexanoic acid (Compound A10, TetraGalNAc) (A10) (Ex. 2)

Into a 250-mL round-bottom flask purged and maintained with an inert atmosphere of nitrogen was charged (S)-2,6-bis(bis((1-(2-(2-(((2R,3R,4R,5R,6R)-3-acetamido-4,5-diacetoxy-6-(acetoxymethyl)tetrahydro-2H-pyran-2-yl)oxy)ethoxy)ethyl)-1H-1,2,3-triazol-4-yl)methyl)amino)hexanoic acid (A9, 6.9 g, 1.0 equiv), $Na_2CO_3$ (6.83 g, 20 eq), water (56 mL), and MeOH (32 mL) in respective order. The reaction was aged at room temperature for 16 h, concentrated to residue, redissolved in water (50 mL), and purified on Combiflash C18 gold reverse column (415 g), eluting with water/MeCN. After concentration under vacuum, the product was dissolved in minimum amount of water, and lyophilized to obtain (S)-2,6-bis(bis((1-(2-(2-(((2R,3R,4R,5R,6R)-3-acetamido-4,5-dihydroxy-6-(hydroxymethyl)tetrahydro-2H-pyran-2-yl)oxy)ethoxy)ethyl)-1H-1,2,3-triazol-4-yl)methyl)amino)hexanoic acid (Compound A10) as a white solid.

MS(m/z): 1657 $[M+Na]^+$ $^1$H NMR ($D_2O$, 500 MHz, ppm): 8.05 (s, 2H), 7.91 (s, 2H), 4.62 (t, J=5.0 Hz, 4H), 4.57 (t, J=5.0 Hz, 4H), 4.45-4.41 (d, J=8.6 Hz, 4H), 3.99-3.82 (m, 28H), 3.80-3.61 (m, 28H), 3.14 (t, J=7.1 Hz, 1H), 2.52 (broad s, 2H), 1.99 (s, 6H), 1.98 (s, 6H), 1.73 (m, 2H), 1.60 (m, 2H), 1.29 (m, 2H).

Section B

Preparation of B2 to B5

Examples 3-6

Figures 1, 5A:
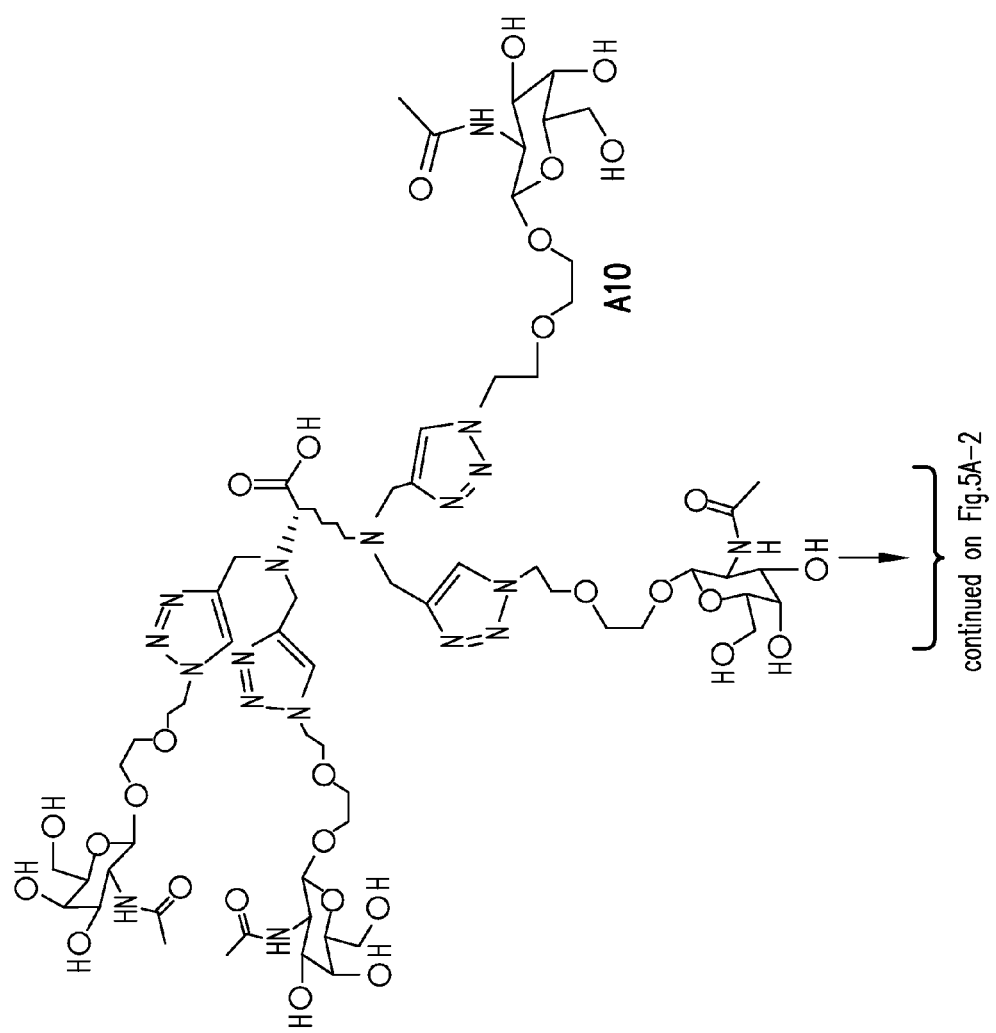
Figures 2, 5A:
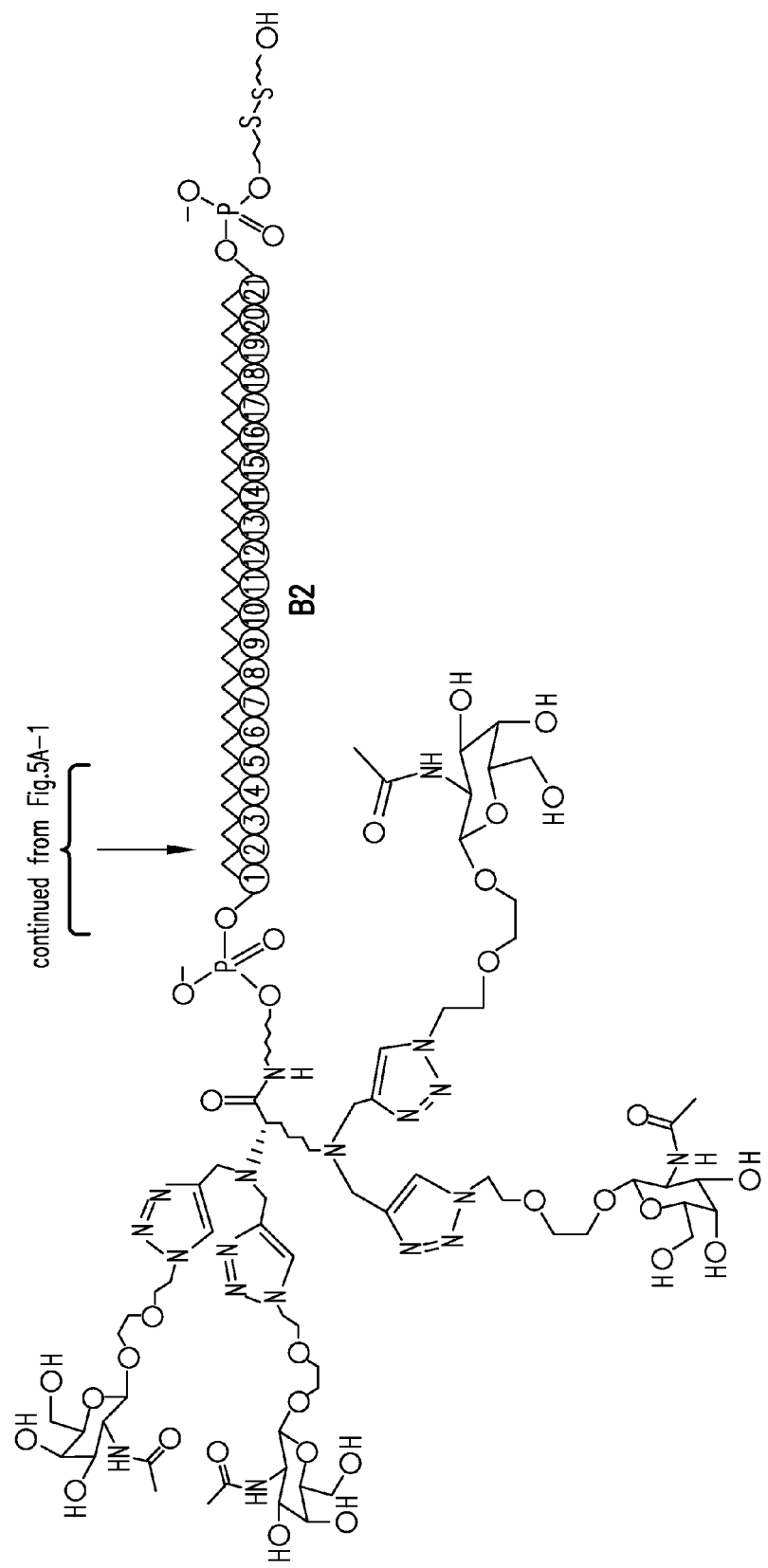
Figure 5B:
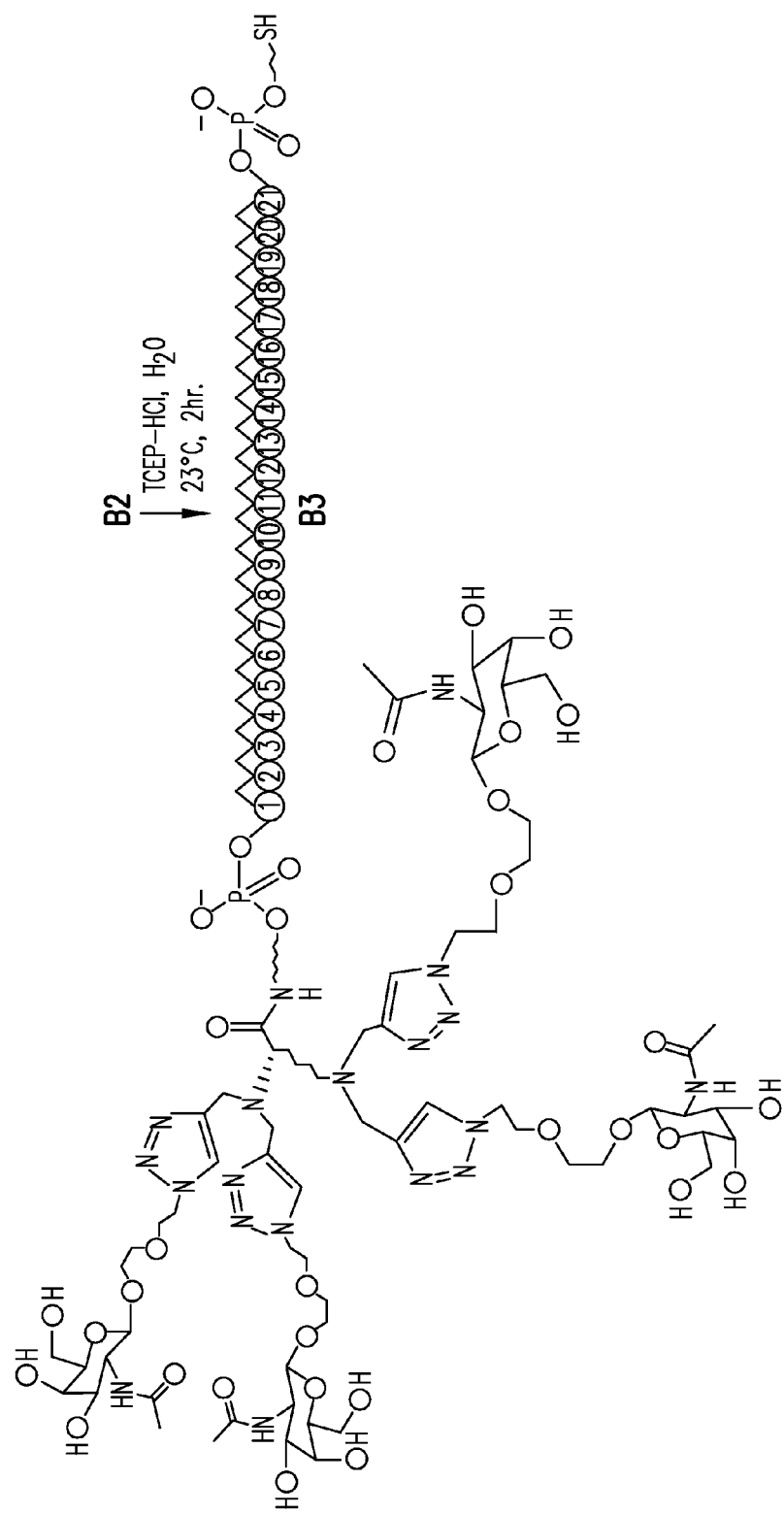
FIG. 5. Scheme 2 as shown in FIG. 5A-1 to FIG. 5D for preparing B Conjugates (Ex. 3-6).
Figure 5C:
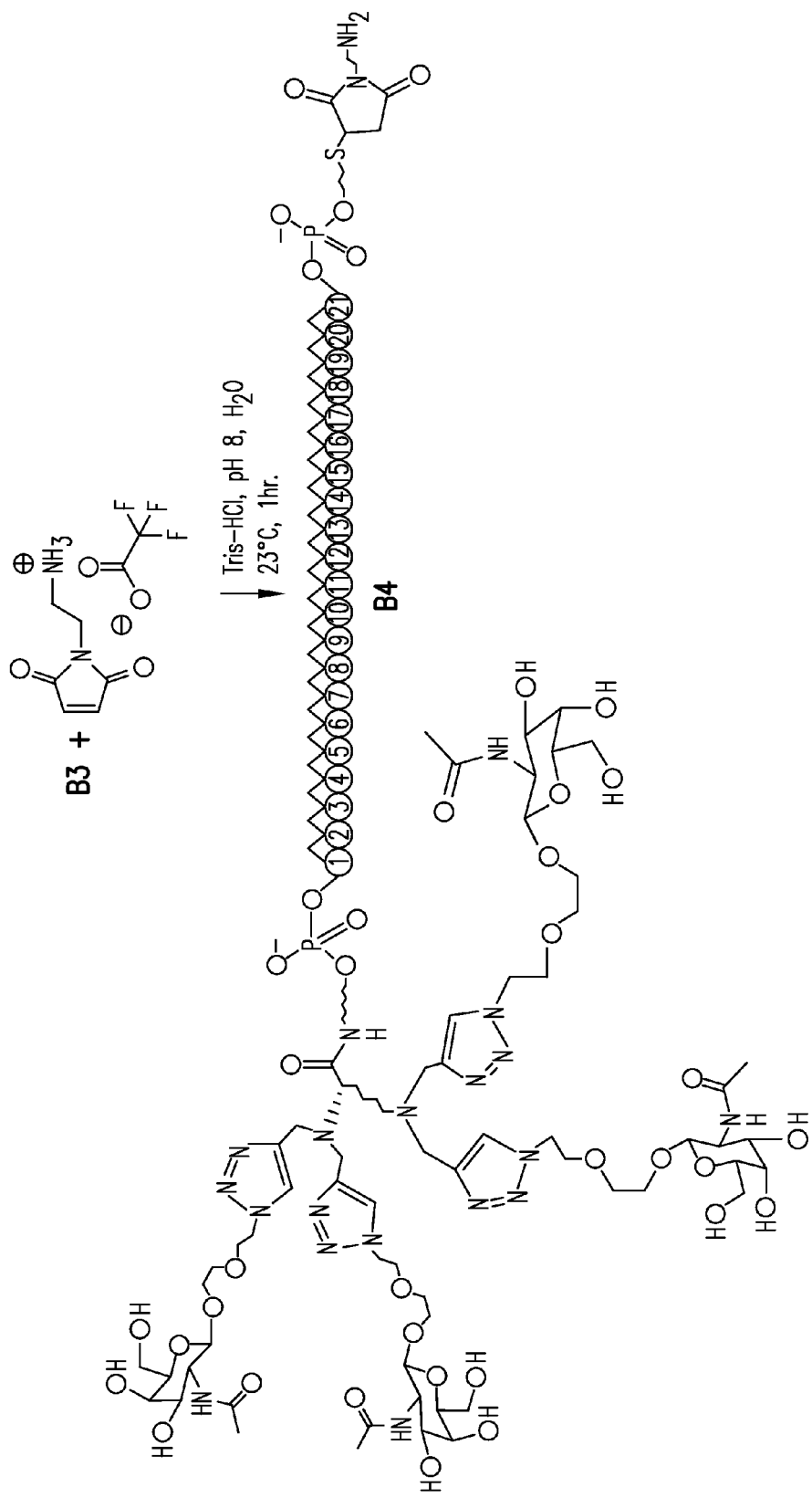
Figure 5D:
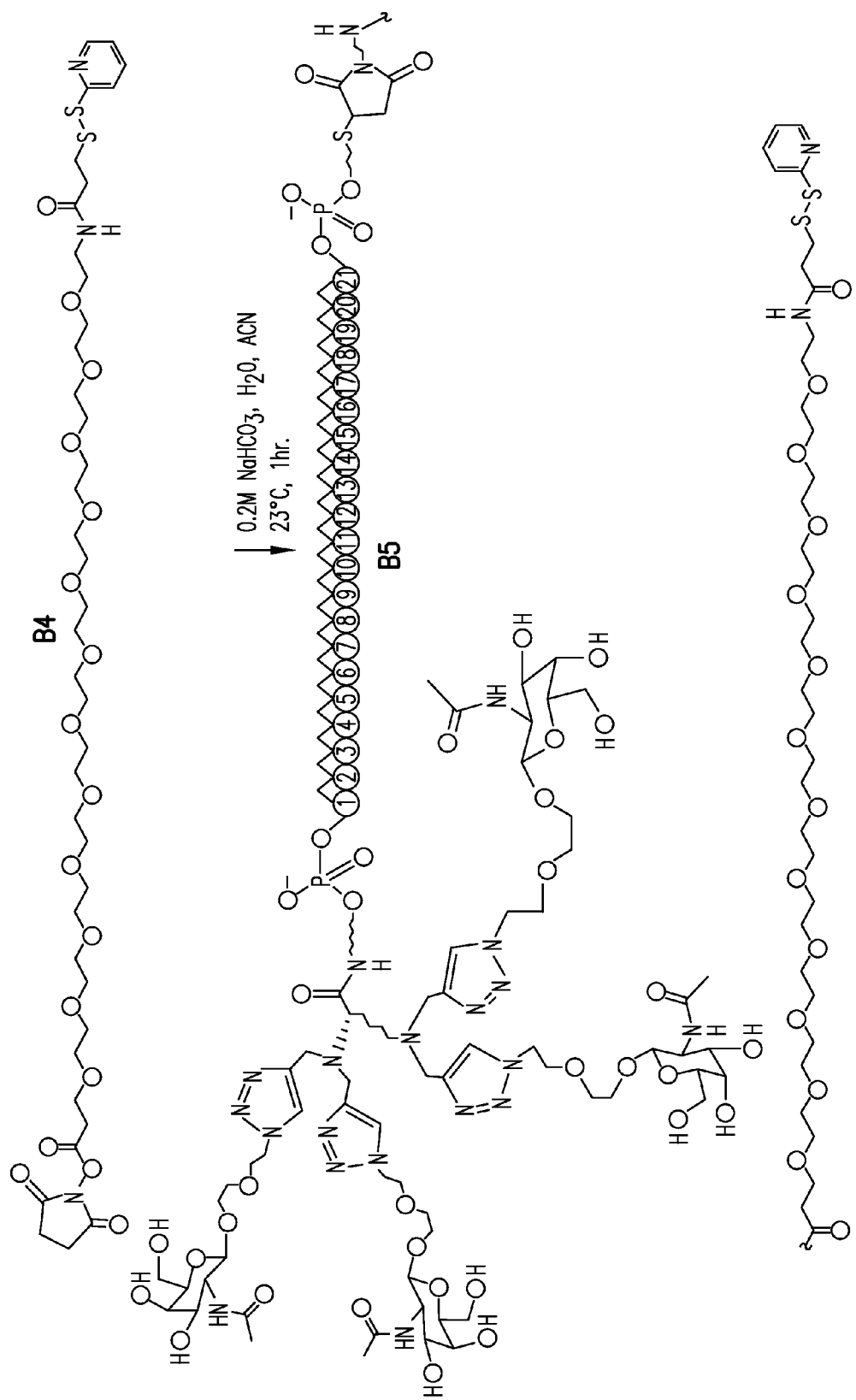

Scheme 2 as shown in FIG. 5A-1 to FIG. 5D, was used to prepare B Conjugates (Ex. 3-6).

Synthesis of B2 (Ex. 3)

A10 (86 mg, 0.053 mmol) and DIEA (57.6 μL, 0.330 mmol) were dissolved in DMSO (500 μL), then added to a solution of HATU (301 μL, 0.079 mmol) and stirred for 15 min. Starting material passenger strand B1 (101 mg, 0.013 mmol) was dissolved in water (168 μL) and DMSO (1.5 mL). The HATU solution was added to the RNA solution and aged for 15 min. The reaction mixture was diluted with water (50 mL) and centrifugal dialyzed three times against water over a 3 k membrane. The concentrate was loaded onto an HPLC fitted with a Dionix ProPac SAX 22×250 mm column. The product was gradient eluted starting at 95% A (2:3 $H_2O$:2,2,2-trifluoroethanol, 20 mM TEA) up to 40% solvent B (2:3 $H_2O$:2,2,2-trifluoroethanol, 20 mM TEA, 1M CsCl). The fractions were diluted with water to reduce the 2,2,2-trifluoroethanol content to 25% and centrifugal dialyzed three times against water over a 3 k membrane. The concentrate was freeze dried to afford the product as a white amorphous solid. Expected mass: 9267.5, found mass: 9267.0

Synthesis of B3 (Ex. 4)

To a solution of B2 (606 mg, 0.065 mmol) in water (32 mL) was added TEAA (1.64 mL, 2M), aqueous DTT (0.65 mL, 1M), and TEA (0.65 mL, 4.69 mmol). The reaction mixture was aged for 10 min. The reaction mixture was then diluted with water and centrifugal dialyzed three times against water over a 3 k membrane. The concentrate was taken forward without further isolation. Expected mass: 9177.4, found mass: 9179.0

Synthesis of B4 (Ex. 5)

To a solution of B3 (350 mg, 0.038 mmol) in water (3 mL) was added N-(2-aminoethyl)-maleimide trifluoroacetate salt (194 mg, 0.763 mmol). The reaction mixture was aged for 30 min, after which it was purified by RP-HPLC (95:5-5:95% A:B linear gradient (A=100 mM aqueous TEAA; B=100 mM TEAA in acetonitrile) Waters Phenyl xbridge Column. Fractions containing B4 were centrifugal dialyzed three times against water over a 3 k membrane and the concentrate was lyophilized to give product as a white amorphous solid.

Synthesis of B5 (Ex. 6)

To a solution of B4 (286 mg, 0.031 mmol) in aqueous sodium bicarbonate (3.0 mL, 200 mM) was added a solution of NHS-dPEG12-SPDP (280 mg, 0.307 mmol) in acetonitrile (0.5 mL). The reaction mixture was aged for 30 min, after which it was treated with aqueous TEAA (1.0 mL, 2M) and purified by RP-HPLC (95:5-5:95% A:B linear gradient (A=100 mM aqueous TEAA; B=100 mM TEAA in acetonitrile) Waters Phenyl xbridge Column. Fractions containing B5 were centrifugal dialyzed three times against water over a 3K membrane and the concentrate was lyophilized to give product as a white amorphous solid. Measured mass=10117

Examples 7-8

Preparation of B6-Seq32

Figure 6A:
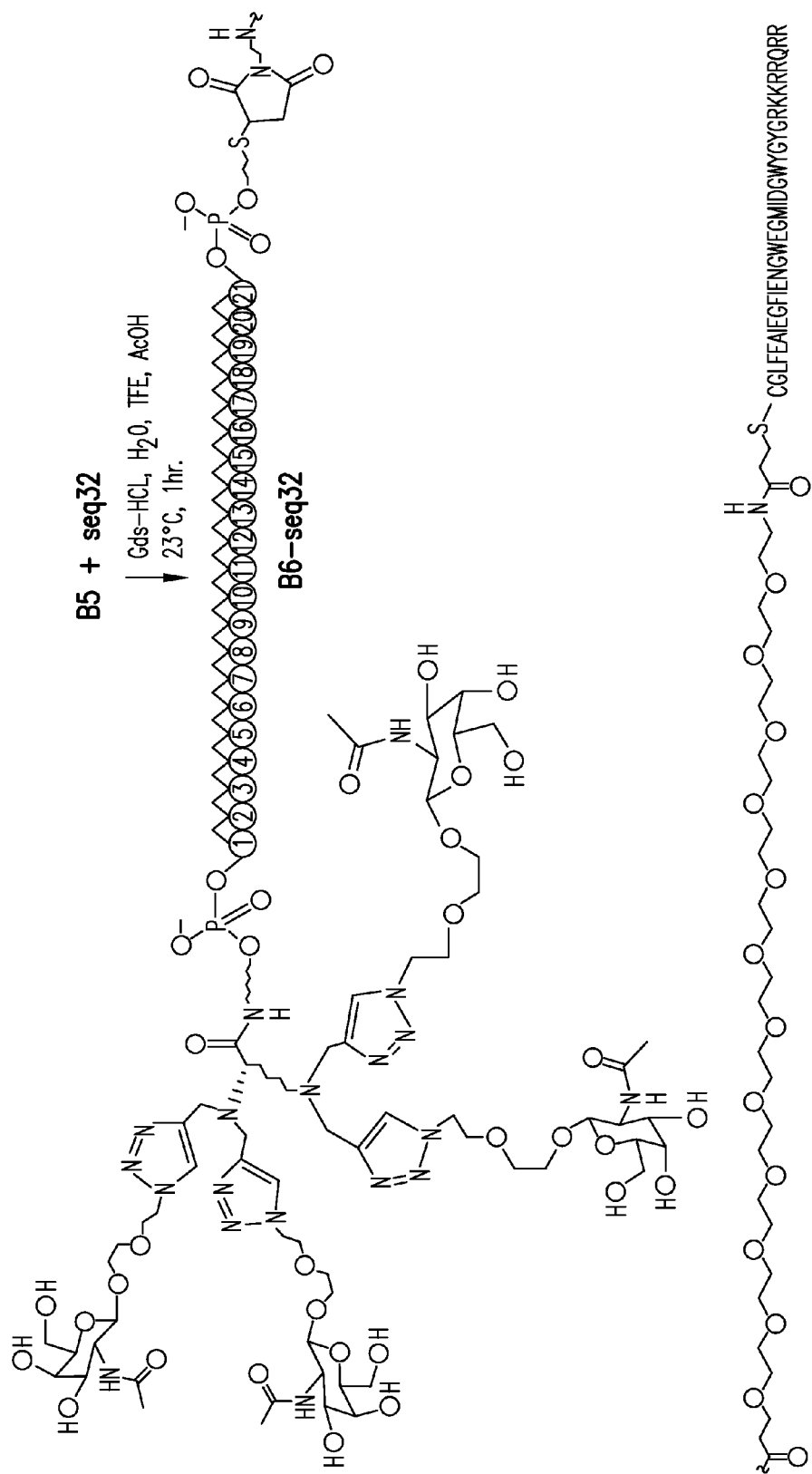
FIG. 6. Scheme 3 as shown as FIG. 6A to FIG. 6B for preparing Conjugates B6-P32 and B8-seq32 (Ex. 7-8). The figures disclose SEQ ID NO: 32.
Figure 6B:
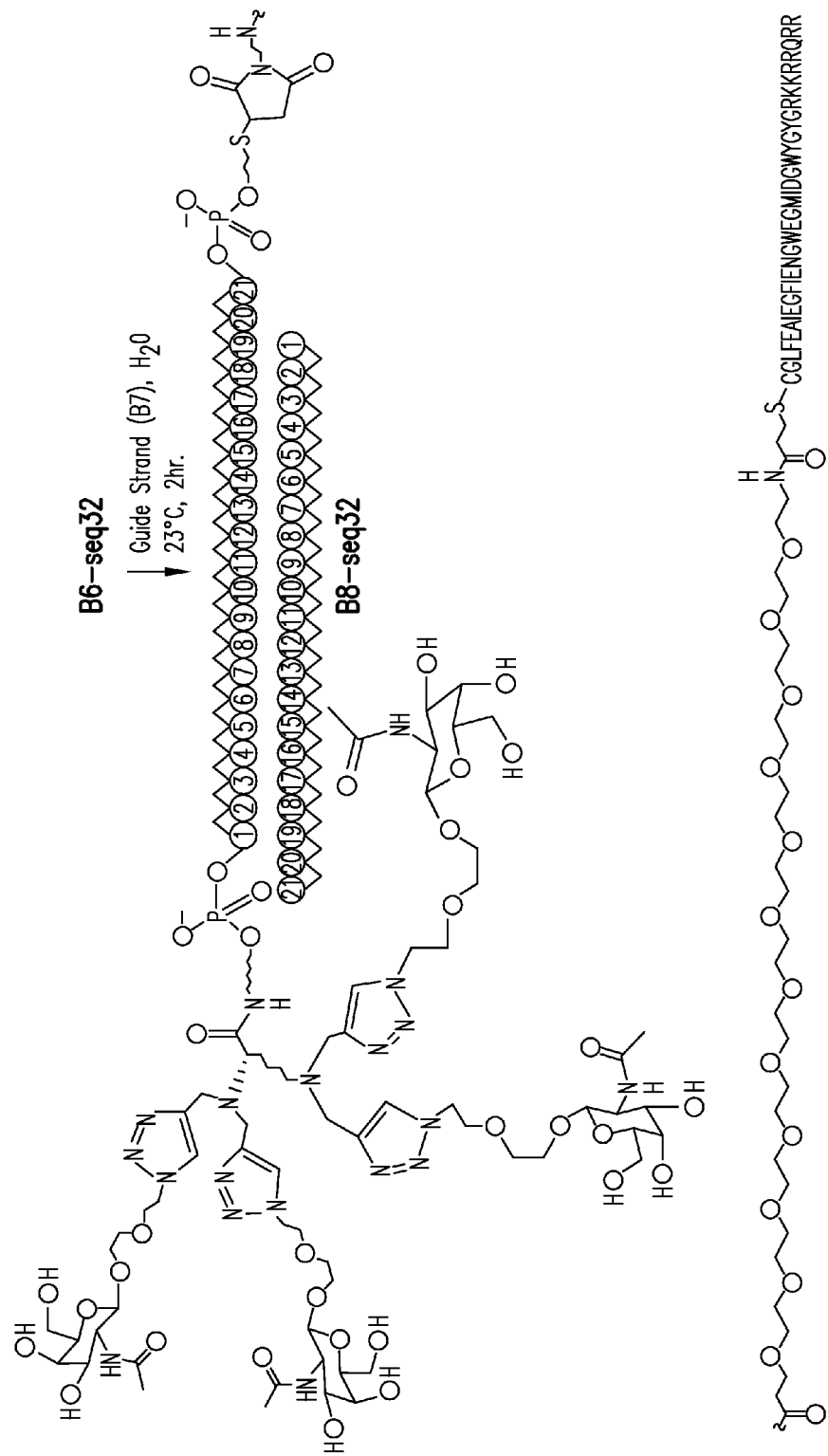

Scheme 3 as shown in FIG. 6A to FIG. 6B was used to prepare Conjugates B6-P32 and B8-seq32 (Ex. 7-8).

Synthesis of Conjugate B6-Seq32 (Ex. 7)

B5 (50 mg, 5 umol, 1 eq.) was dissolved in 50 mM AcOH in 2,2,2-trifluoroethanol (5 mL). Peptide Seq32 (51 mg, 13 umol, 2.5 eq.) was dissolved in guanidine-HCl (8M, 500 uL), diluted with 50 mM AcOH in 2,2,2-trifluoroethanol (5 mL). The peptide solution was added dropwise to the stirring RNA solution over 5 min, and the reaction was left at room temperature for 1 hour. The reaction was diluted with formamide (10 mL), and 1.5 mL aliquots of the reaction mixture were loaded onto an HPLC fitted with a Dionex ProPac SAX-10 22×250 mm column. The product was gradient eluted starting at 98% solvent A (2:3 $H_2O$:2,2,2- trifluoroethanol, 40 mM TEA) up to 35% solvent B (2:3 H₂O:2,2,2-trifluoroethanol, 40 mM TEA, 1M guanidine-HCl) over 10 min at 20 mL/min. The fractions were diluted with water to reduce the 2,2,2-trifluoroethanol content to 25% and centrifugal dialyzed three times against water over a 10 k membrane. The concentrate was freeze dried to afford the product as a white amorphous solid. Expected mass: 13961.9, found mass: 13962.0

Synthesis of Conjugate B8-Seq32-b (Ex. 8)

Guide strand (B7, 17.7 mg) was dissolved in water (5 mL) and added to a vial containing B6-seq 42 (36.2 mg). The solution was thoroughly mixed and left at room temperature for 2 hours. The solution was freeze dried to afford the duplex as a white amorphous solid.

Synthesis of Additional B8-Peptide Conjugates

Additional conjugates of B8 and Peptide Sequence and duplexes were prepared in a manner analogous to that used for B8-seq32-b.

Examples 9-11

Preparation of B9 and B10-Seq32 and 11-Seq32

Scheme 4 as shown in FIG. 7A, FIG. 7B and FIG. 7C was used to prepare B9, B10-seq32 and B11-seq32.

Synthesis of B9 (Ex. 9)

Compound B3 (120 mg, 0.0132 mmol) in water (5 mL) was added dropwise to a stirring solution of 2,2'-dipyridyldisulfide (29 mg, 0.132 mmol, 10 eq.) dissolved in methanol (5 mL). The solution was diluted with water to bring the methanol content to 20% and centrifugal dialyzed three times against water over a 3K membrane. The concentrate was freeze dried to afford the product as an amorphous white solid. Expected mass: 9166.5, found mass: 9165.5

Synthesis of B10-Seq32 (Ex. 10)

B9 (15 mg, 1.615 umol) was dissolved in water (150 uL) and was diluted with 50 mM AcOH in TFE (1.5 mL). In a separate vial, P32 (8.79 mg, 2.155 umol) was dissolved in 8 M guanidine HCl (60 uL) and diluted with 50 mM AcOH in TFE (1.5 mL), then added to the RNA solution. The reaction mixture was aged for 15 min, then was diluted with formamide and purified by AEX (95:5-55:45 A:B linear gradient (A=20 mM TEA in 60% aqueous TFE; B=1M CsCl and 20 mM TEA in 60% aqueous TFE), Dionix Propac column. Fractions containing B10-Seq 32 were centrifugal dialyzed three times against water over a 10K membrane and the concentrate was lyophilized to give product as a white amorphous solid.

Synthesis of B11-Seq32-b (Ex. 11)

B10-seq 32 (9.68 mg, 0.730 umol) was treated with a solution of B7 (5.00 mg, 0.730 umol) dissolved in PBS (500 uL) and aged for 30 min. Excess guide strand was removed by AEX purification (95:5-55:45 A:B linear gradient (A=20 mM TEA in 60% aqueous TFE; B=1M CsCl and 20 mM TEA in 60% aqueous TFE), Dionix Propac column. Fractions containing B11-seq 32 were centrifugal dialyzed three times against water over a 10K membrane and the concentrate was lyophilized to give product as a white amorphous solid.

Examples 12-14

Additional Synthesis of B11-Peptide Conjugates

Additional conjugates of B11 and peptide sequences and corresponding duplexes were prepared in a manner analogous to that used for B11-seq32-b.
Scheme 5 is shown in FIG. 7D, FIG. 7E and FIG. 7F.

Synthesis of B12 (Ex. 12)

B3 (50 mg, 5.4 μmol) was dissolved in water (3 mL, ~17 mg/mL) and Compound 1, 1,1'-(ethane-1,2-diyl)bis(1H-pyrrole-2,5-dione), (16 mg, 0.073 mmol) was dissolved in DMF (1.2 mL) in separate vials. The B3 solution was added to Compound 1 solution and stirred for 10 min. The reaction was diluted with water to 15 mL and then dialyzed 4 times on 3 K MWCO membrane against water. The reaction was then filtered (0.22 μm syringe filter) and lyophilzed to afford a white solid, B12. Expected mass: 9397.535. Observed mass: 9400.0.

Synthesis of B12-Seq13 (Ex. 13)

See Synthesis of B10-seq32 for reaction procedure. B12-seq13. Expected mass: 13518.215

Synthesis of B13-Seq13-b (Ex. 14)

See Synthesis of B11-seq32 for reaction procedure. B13-seq13-b. Expected mass: 20370.215

Additional Synthesis of B13-Peptide Conjugates

Additional conjugates of B13 and peptide sequences were prepared in a manner analogous to that used for B13-seq13.

Examples 15-16

Preparation of B15-Seq32 and B16-Seq32-b

Scheme 6 as shown in FIG. 7G-1 to FIG. 7G-2 was used to prepare B16-seq32 and B17-seq32-b.

Synthesis of B14

B3 (100 mg, 10.9 μmol) was dissolved in water (10 mL) and dioxane (20 mL) was treated with bis maleimide dissolved in dioxane (3.8 mL) to give a cloudy mixture. The reaction was stirred for 1.5 hours, after which it was quenched with N-methylmaleimide (36.3 mg, 0.327 mmol). The reaction mixture was diluted with water and centrifugal dialyzed once against water over a 3 k membrane. The concentrate was filtered and purified by RP-HPLC (95:5-5:95% A:B linear gradient (A=100 mM aqueous TEAA; B=100 mM TEAA in acetonitrile) Waters Phenyl xbridge Column). Fractions containing product were dialyzed and lyophilized to give B14 as an amorphous white powder. Measured mass=9531

Synthesis of B15-Seq 32 (Ex. 15)

B14 (5 mg, 0.524 μmol) was dissolved in formamide solution (2M thiourea, 50 mM MES buffer at pH 6.5, 500

μL). In a separate vial, peptide sequence 32 (4.28 mg, 1.048 μmol) was dissolved in formamide solution (2M thiourea, 50 mM MES buffer at pH 6.5, 500 μL), then was added to the RNA solution. After aging one hour at room temperature, the reaction mixture was loaded onto an HPLC fitted with a Dionex ProPac SAX-10 22×250 mm column. The product was gradient eluted starting at 98% solvent A (2:3 H2O:2, 2,2-trifluoroethanol, 40 mM TEA) up to 35% solvent B (2:3 H2O:2,2,2-trifluoroethanol, 40 mM TEA, 1M guanidine-HCl) over 10 min at 20 mL/min. The fractions were diluted with water to reduce the 2,2,2-trifluoroethanol content to 25% and centrifugal dialyzed three times against water over a 10 k membrane. The concentrate was freeze dried to afford the product as a white amorphous solid.

Synthesis of B16-Seq32-b (Ex. 16)

B15-seq 32 (2.11 mg, 0.155 μmol) was treated with a solution of B7 (1.062 mg, 0.155 μmol) in water (212 μL) and aged at room temperature for 2 hours. The solution was lyophilized to give the product as a white amorphous solid.

Section C

Examples 17-21

Preparation of C1 to C3, C4-Seq32 and C6-Seq32

Scheme 7 as shown in FIG. 8A to FIG. 8D was used to prepare C1 to C3, C4-seq32 and C6-seq32.

Synthesis of C1 (Ex. 17)

1,2-Diaminododecane (100 mg, 0.499 mmol) was dissolved in chloroform (3.3 mL) and cooled to 0° C., then treated with N-methoxycarbonyl-maleimide (234 mg, 1.50 mmol) and tetrabutylammonium hydrogen sulfate (170 mg, 0.499 mmol). DIPEA (209 uL, 1.20 mmol) was slowly added and the reaction aged for 10 minutes at 0° C. The ice bath was removed and the reaction was treated with aqueous saturated sodium bicarbonate solution (6.6 mL). After aging 3.5 hours at room temperature, the reaction mixture was extracted with ethyl acetate (3×15 mL). The combined organic layers were dried with sodium sulfate and then solvent removed in vacuo. The crude product was purified by flash chromatography with a 100:0-0:100% A:B linear gradient (A=hexanes; B=ethyl acetate). Fractions containing product were pooled and concentrated to give C1 as a fine white powder. $^1$H NMR (CDCl$_3$): 1.24-1.28 (m, 12H), 1.55-1.61 (m, 4H), 3.50 (t, 4H J=7.4 Hz), 6.68 (s, 4H). Measured mass=361.

Synthesis of C2 (Ex. 18)

Step 1. 3' Hamino 5' C6 disulfide siRNA (46.9 mg, 6.16 μmol) was dissolved in 9:1 DMSO/water (782 μl). Tetra-GalNAc (40.0 mg, 0.025 mmol) and DIEA (26.9 μl, 0.154 mmol) were dissolved in DMSO (200 μl), then added solution of HATU (14.0 mg, 0.037 mmol) in DMSO (141 μL) and stirred at RT for 15 minutes. This solution was added to the RNA solution and aged for 30 minutes. The reaction was diluted with DI water and dialyzed once to remove DMSO and purified by AEX (95:5-65:35 A:B linear gradient (A=20 mM TEA in 60% aqueous TFE; B=1M CsCl and 20 mM TEA in 60% aqueous TFE), Dionix Propac column). Fractions containing product were pooled, dialyzed, and lyophilized. Measured mass=9233.

Step 2. To this solid (30.8 mg, 3.34 μmol) was added TCEP (19.13 mg, 0.067 mmol) and DI water (2 mL). The reaction was stirred at RT for 1 hour, then aged overnight at 5° C. The reaction was diluted with DI water and dialyzed twice against DI water to give a solution of C2 that was used in further reactions without isolation.

Synthesis of C3 (Ex. 19)

C2 (60.1 mg, 6.60 umol, prepared in a manner analogous to B3) dissolved in DI water (37 mL) was treated with C1 (23.8 mg, 66.0 umol) dissolved in DMF (7 mL) to give a cloudy solution. The reaction was aged overnight, at which point dioxane (18 mL) was added to solubilize the reaction mixture. After aging for 30 additional minutes, the reaction was diluted with DI water. It was then dialyzed once against DI water, filtered, and purified by RP-HPLC (95:5-5:95% A:B linear gradient (A=100 mM aqueous TEAA; B=100 mM TEAA in acetonitrile) Waters Phenyl xbridge Column). Fractions containing product were dialyzed and lyophilized to give C3 as an amorphous white powder. Measured mass=9458.

Synthesis of C4-Seq32 (Ex. 20)

C3 (10 mg, 1.057 umol) was dissolved in formamide modified with 20 mM MES buffer and 2 M thiourea (1 mL) and was added to P32 (8.62 mg, 2.11 umol). After 20 mins, LC-MS indicated good conversion to desired product. Reaction was purified by AEX (95:5-55:45 A:B linear gradient (A=20 mM TEA in 60% aqueous TFE; B=1M CsCl and 20 mM TEA in 60% aqueous TFE), Dionix Propac column). Fractions containing product were dialyzed to give C4-P32.

Synthesis of C6-Seq32-(Ex. 21)

C4 (6.78 mg, 0.501 μmol) dissolved in DI water (3.40 mL) was treated with guide strand C5 (3.44 mg, 0.501 μmol) dissolved in DI water (530 μL). Analytical SAX indicated good duplex purity with some excess guide strand observed. Solution was lyophilized to give C6 as an amorphous white powder. Measured mass=passenger strand: 13539, guide strand: 6869.

Additional Synthesis of C6-Peptide Conjugates

Additional conjugates of C6 and Peptide Sequence were prepared in a manner analogous to that used for C6-seq32-c.

Examples 22-27

Preparation of C7 to C10, C11-P32 and C12-Seq32-a

Scheme 8 as shown in FIG. 9A to FIG. 9E was used to prepare C7 to C10, C11-seq32 and C12-seq32.

Synthesis of C7 (Ex. 22)

Icosanedioic acid (600 mg, 1.752 mmol) was suspended in toluene (11 mL) and treated with DIEA (673 μL, 3.85 mmol) and DPPA (793 uL, 3.68 mmol). After stirring at room temp for 30 minutes, the reaction was slowly heated to 80° C., then to gentle reflux for two hours. Reaction was cooled and treated with tBuOH (1.675 mL, 17.52 mmol) and copper iodide (200 mg, 1.051 mmol) and heated back to reflux for 2 additional hours. Reaction was cooled (precipitation observed), diluted with DCM, filtered, and concentrated in vacuo. The crude product was purified by flash chromatography with a 100:0-0:50% A:B linear gradient (A=hexanes; B=ethyl acetate). Fractions containing product were pooled and concentrated to give C7. Measured mass=486.

Synthesis of C8 (Ex. 23)

C7 (101 mg, 0.208 mmol) was dissolved in DCM (20 mL) and treated with TFA (20 mL). The reaction was aged for five minutes, after which solvent and TFA were removed in vacuo to give C8 as a colorless oily solid that was used without further purification. Measured mass=286.

Synthesis of C9 (Ex. 24)

C8 (100.0 mg, 0.209 mmol) was suspended in chloroform (28 mL) and treated with tetrabutylammonium hydrogen sulfate (70.9 mg, 0.209 mmol), N-methoxy carbonyl maleimide (98.0 mg, 0.631 mmol), and DIEA (88.0 µL, 0.502 mmol). Saturated sodium bicarbonate (28 mL) was added. The reaction was stirred vigorously for 25 hours, after which it was extracted 3×50 mL DCM. The combined organic layers were dried with sodium sulfate, then evaporated to dryness. The crude product was purified by flash chromatography with a 100:0-0:50% A:B linear gradient (A=hexanes; B=ethyl acetate). Fractions containing the desired product were combined and evaporated to give C9. $^1$H NMR (CDCl$_3$): 1.24-1.26 (m, 28H), 1.55-1.59 (m, 4H), 3.50 (t, 4H J=7.4 Hz), 6.68 (s, 4H). Measured mass=445.

Synthesis of C10 (Ex. 25)

C2 (12.0 mg, 1.31 µmol) was dissolved in 1:3 water:dioxane (14.4 mL) and was treated with C9 (5.8 mg, 13.1 µmol) dissolved in 1.4 mL dioxane. After aging overnight, the reaction was quenched with N-methyl maleimide (4.38 mg, 39.4 µmol) and was diluted with DI Water. The crude reaction was dialyzed once against DI water, filtered, and purified by RP-HPLC (95:5-5:95% A:B linear gradient (A=100 mM aqueous TEAA; B=100 mM TEAA in acetonitrile) Waters Phenyl xbridge Column). Fractions containing product were dialyzed against DI water and lyophilized to give C10. Measured mass: 9546.

Synthesis of C11-Seq32 and C12-Seq32-c (Ex. 26 and Ex. 27)

Conjugates C11-seq32 and C12-seq32-c were prepared in a manner analogous to that used for C4-seq32 and C6-seq32.

Additional Synthesis of C12-Peptide Conjugates

Additional conjugates of C12 and peptide sequence were prepared in a manner analogous to that used for C12-seq32.

Section D

Examples 28-30

Preparation of C13, C14-Seq32 and C15-Seq32

Figure 10A:
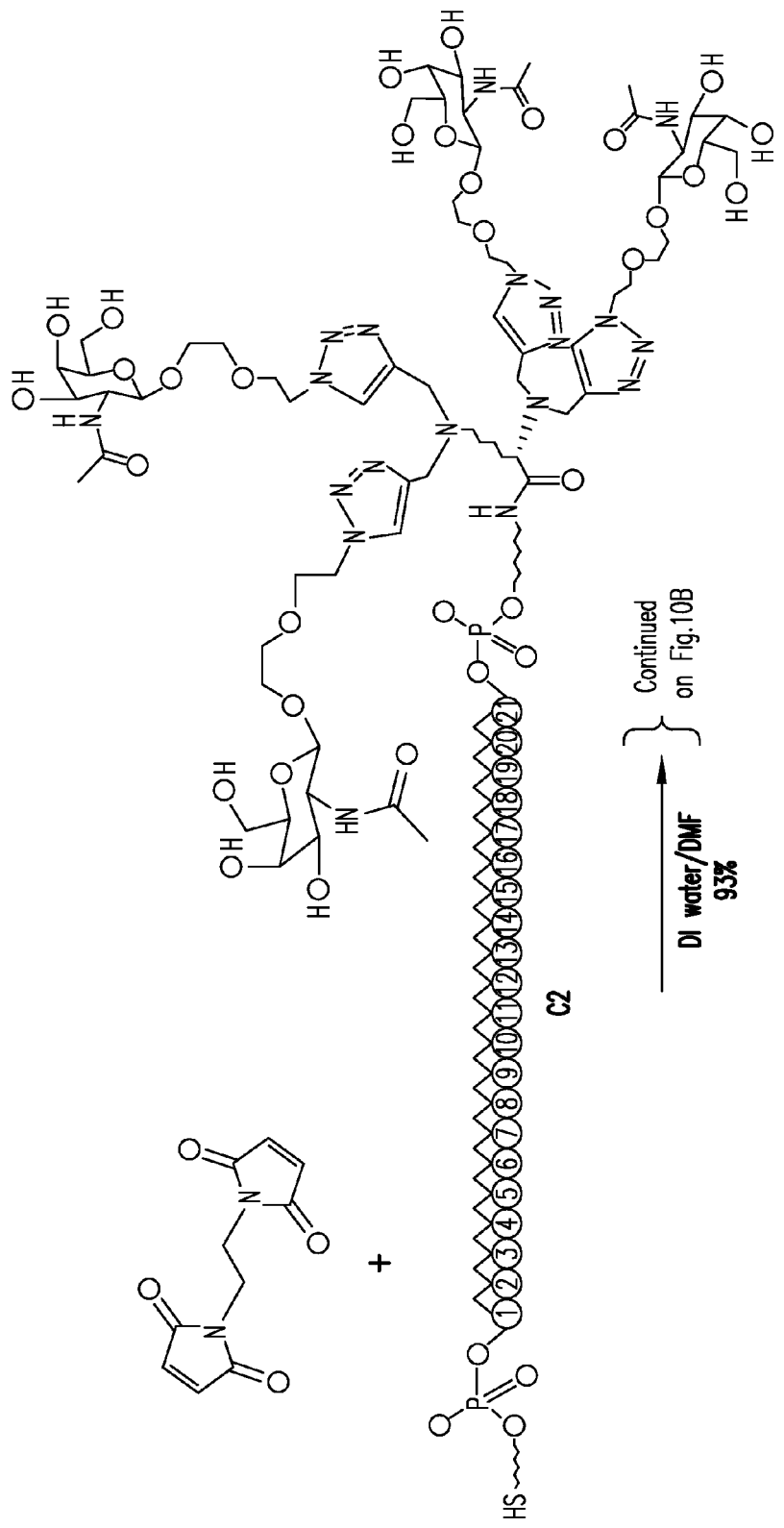
Figure 10B:
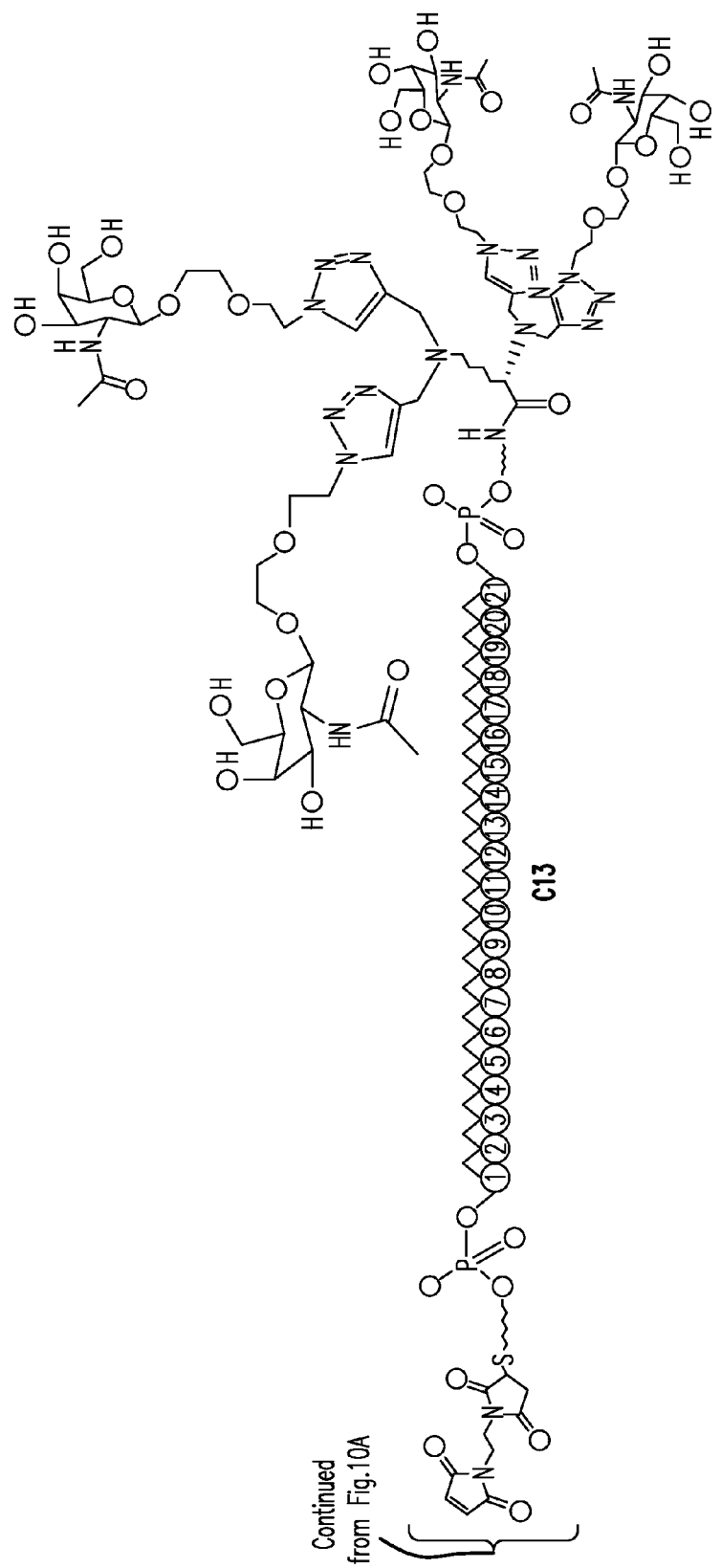
Figure 10C:
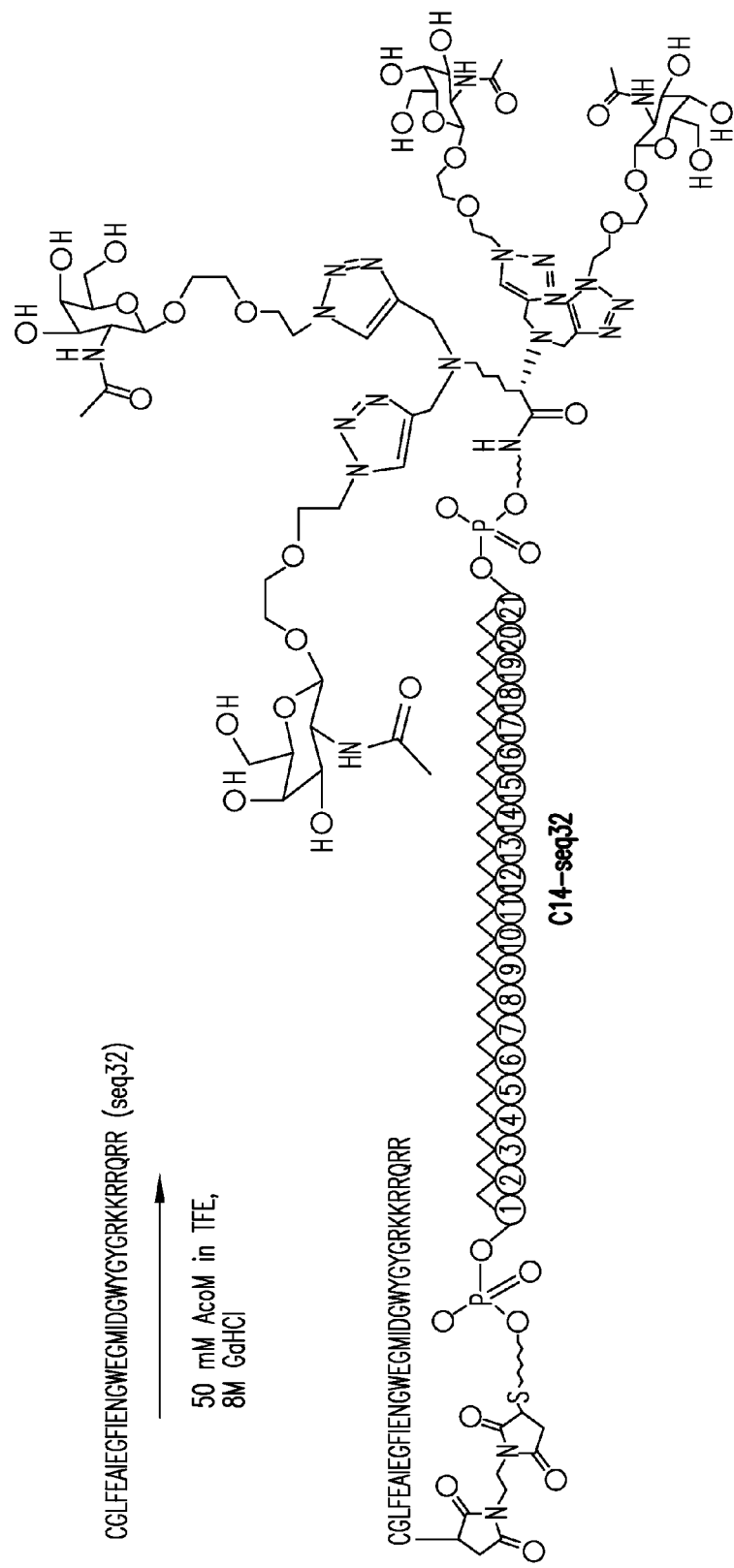
Figure 10D:
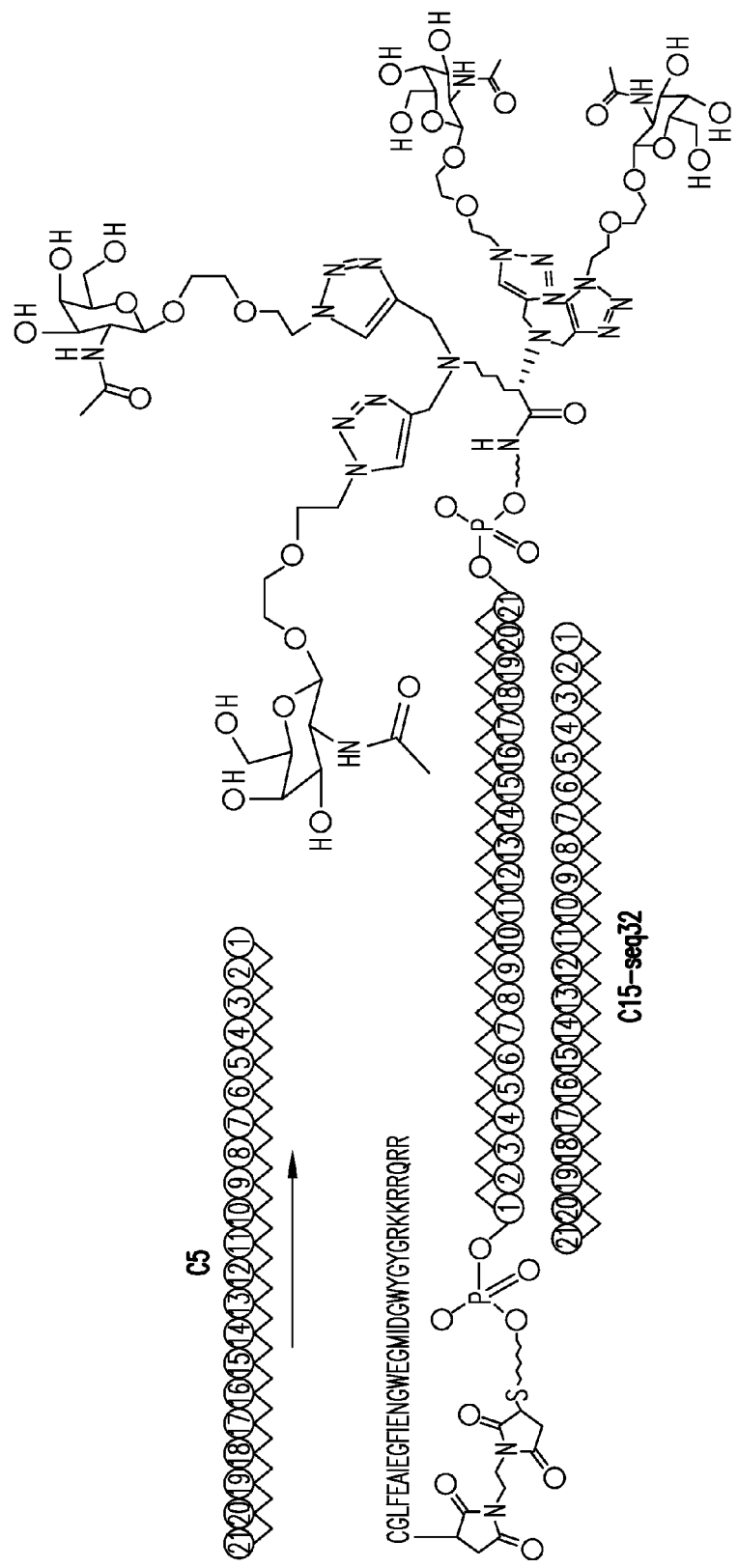

Scheme 9 shown in FIG. 10 A to FIG. 10D was used to prepare C13, C14-seq32 and C15-seq32-a.

Synthesis of C13 (Ex. 28)

C2 (11 mg, 1.22 µmol) dissolved in DI water (3.5 mL) was treated with C2 bismaleimide (2.69 mg, 12.20 umol) dissolved in DMF (270 µL). After one hour, LC-MS indicated good conversion to desired product. Reaction was dialyzed 3 times against DI water and lyophilized to give C13. Measured mass: 9317.

Synthesis of C14-Seq32 (Ex. 29)

C13 (10.53 mg, 1.13 µmol) was dissolved in DI water (50 µL) and diluted with TFE modified with 50 mM AcOH (2.0 mL), then was added to seq32 (9.22 mg, 2.26 µmol) dissolved in 8M guanidine hydrochloride (60 µL). The reaction was aged for 10 minutes. Reaction was purified by AEX (95:5-55:45 A:B linear gradient (A=20 mM TEA in 60% aqueous TFE; B=1M CsCl and 20 mM TEA in 60% aqueous TFE), Dionix Propac column). Fractions containing product were dialyzed to give C14-seq32.

Synthesis of C15-Seq32-c (Ex. 30)

C14-seq32 (9.81 mg, 0.738 µmol) dissolved in DI water (2.6 mL) was treated with guide strand C5 (7.76 mg, 0.738 µmol) dissolved in DI water (751 µL). Solution was lyophilized to give the desired product C15-seq32-c. Measured mass=passenger strand: 13396, guide strand: 6868

Additional Synthesis of C15-Peptide Conjugates

Additional conjugates of C15 and peptide sequence were prepared in a manner analogous to that used for C15-seq32.

Examples 31-33

Preparation of D1, D3 and D4

Figure 11A:
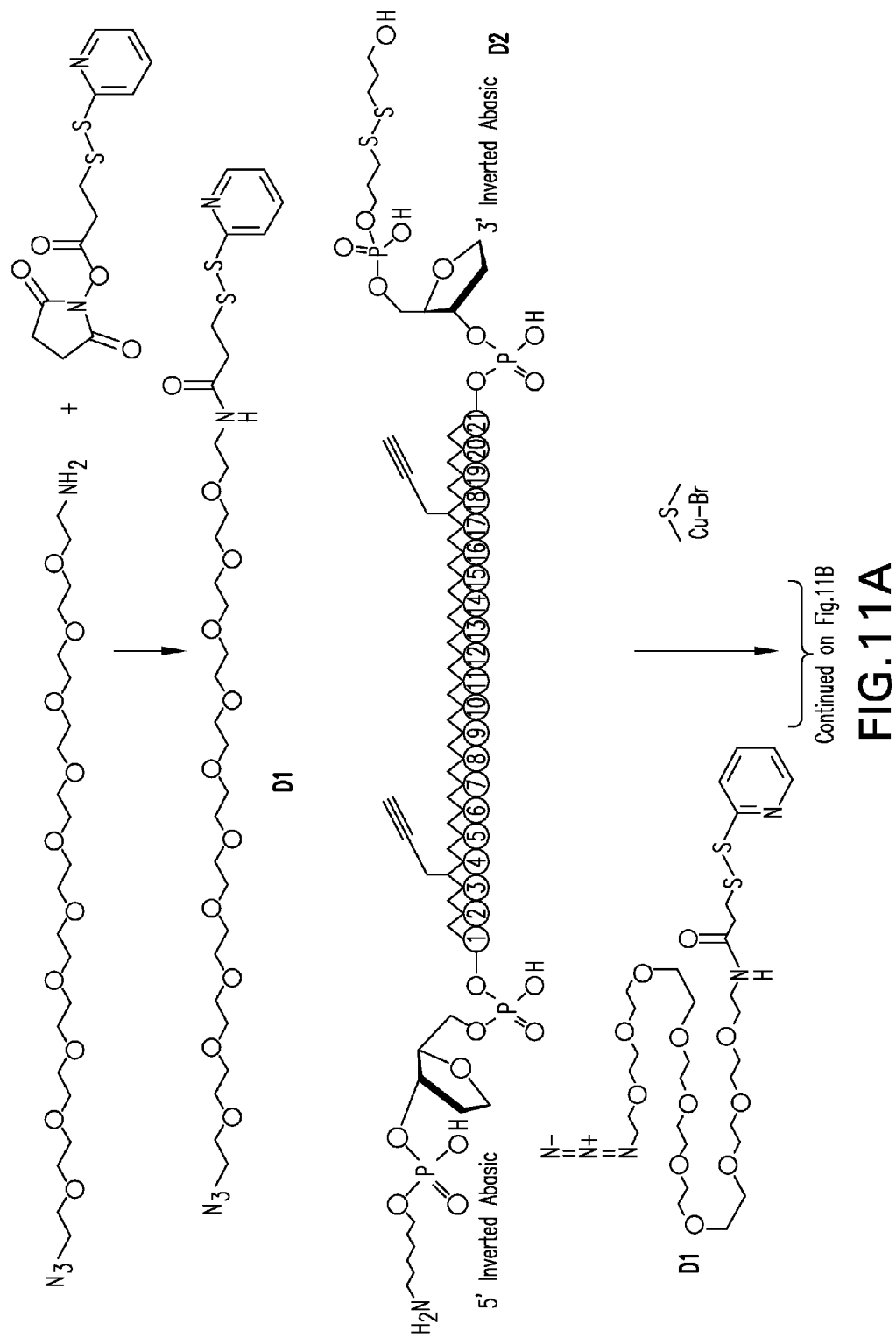
Figure 11B:
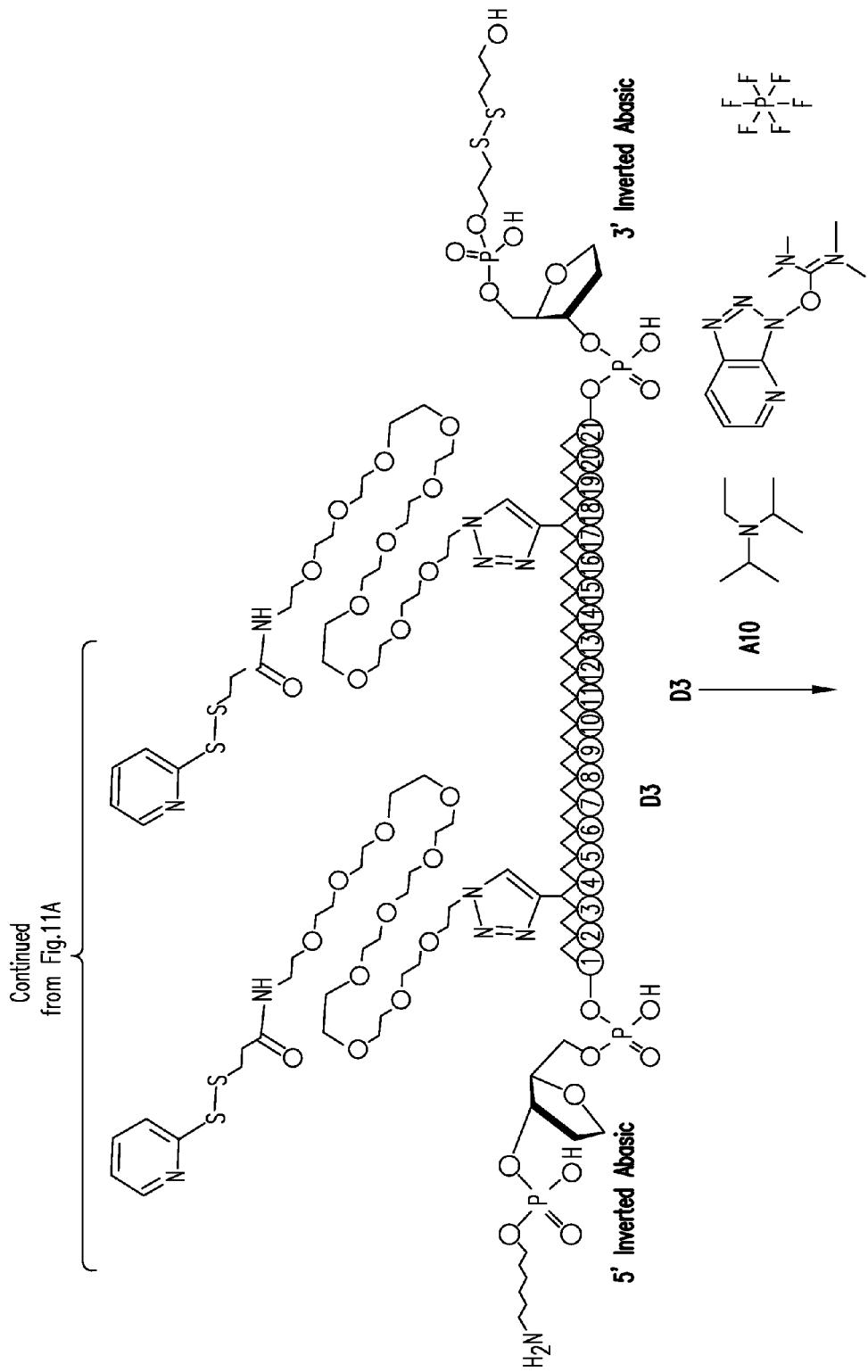
Figure 11C:
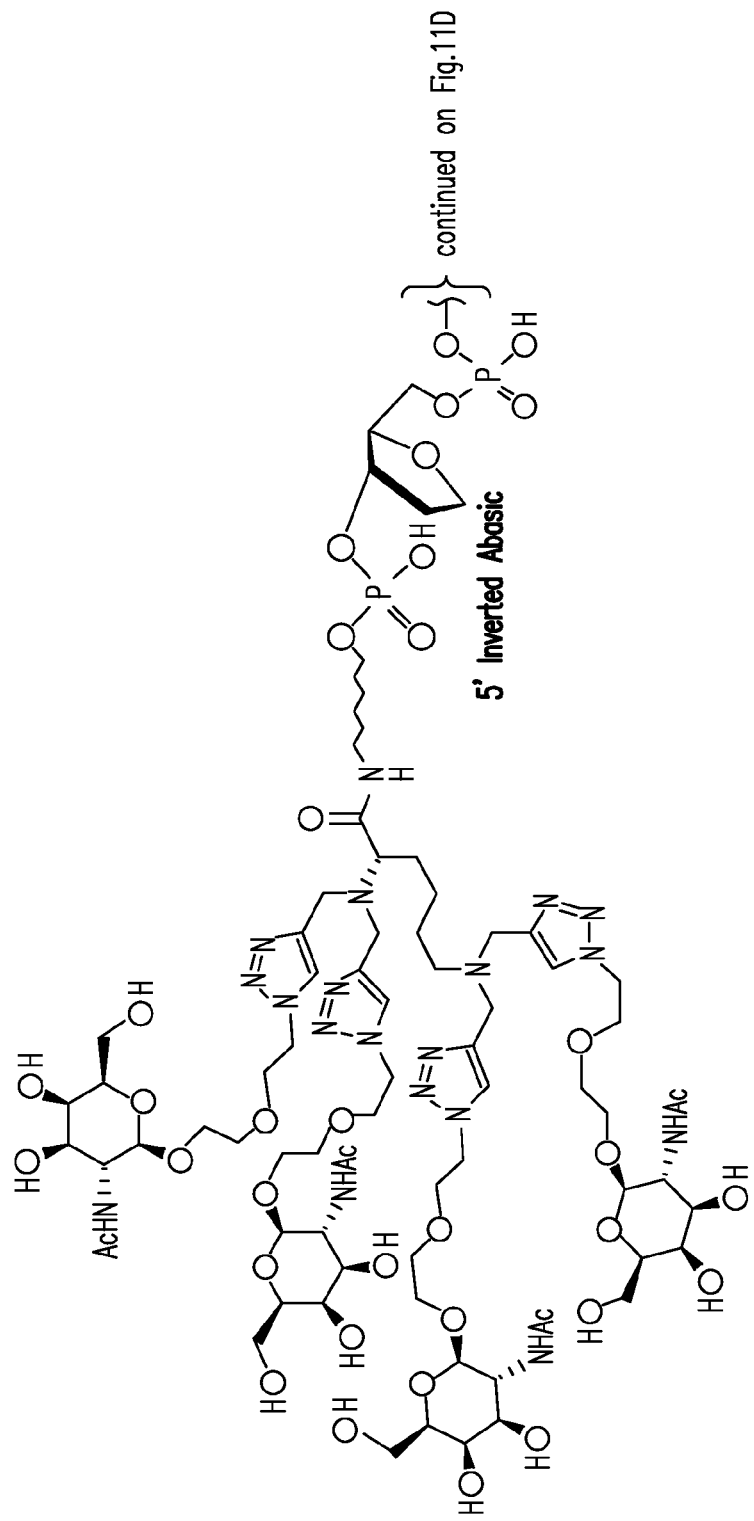
Figure 11D:
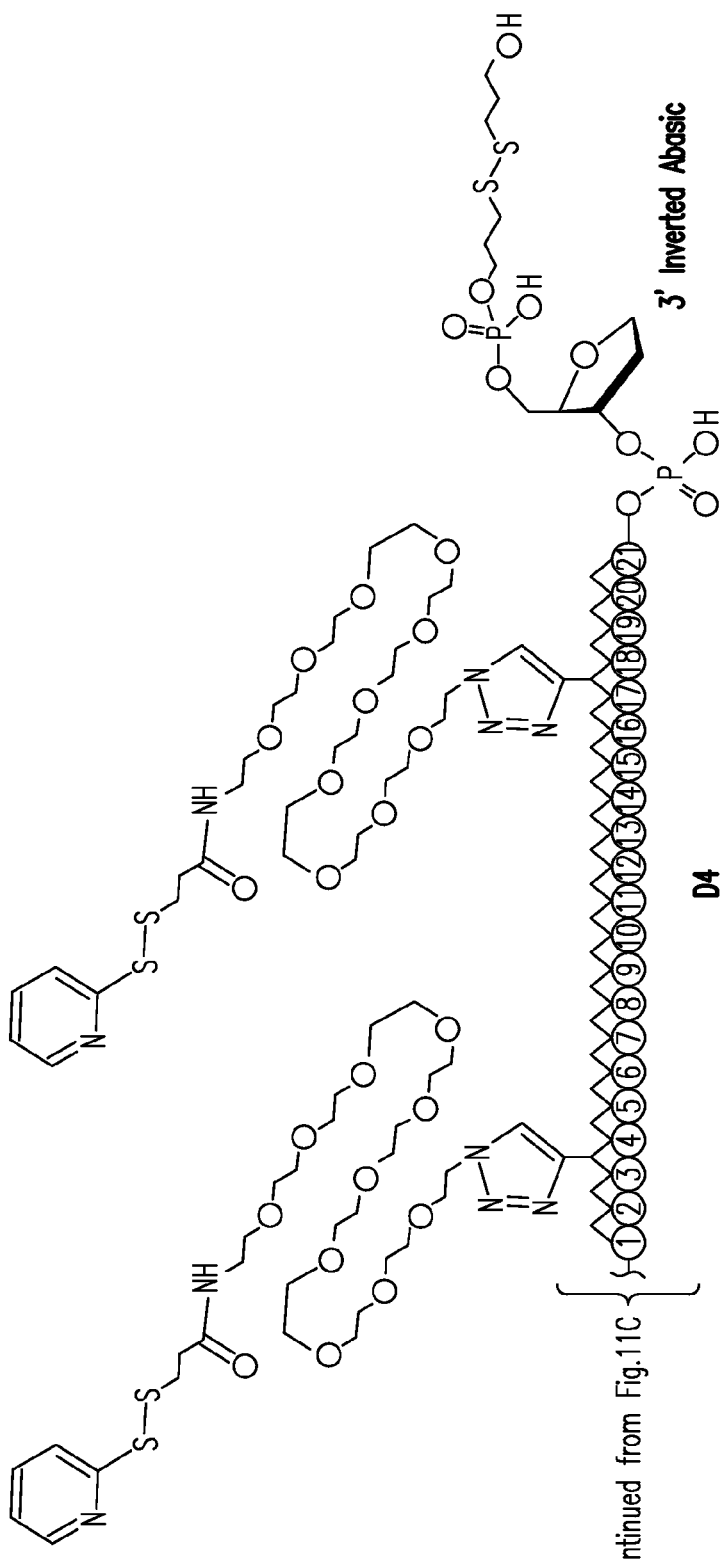
Figures 1, 12A:
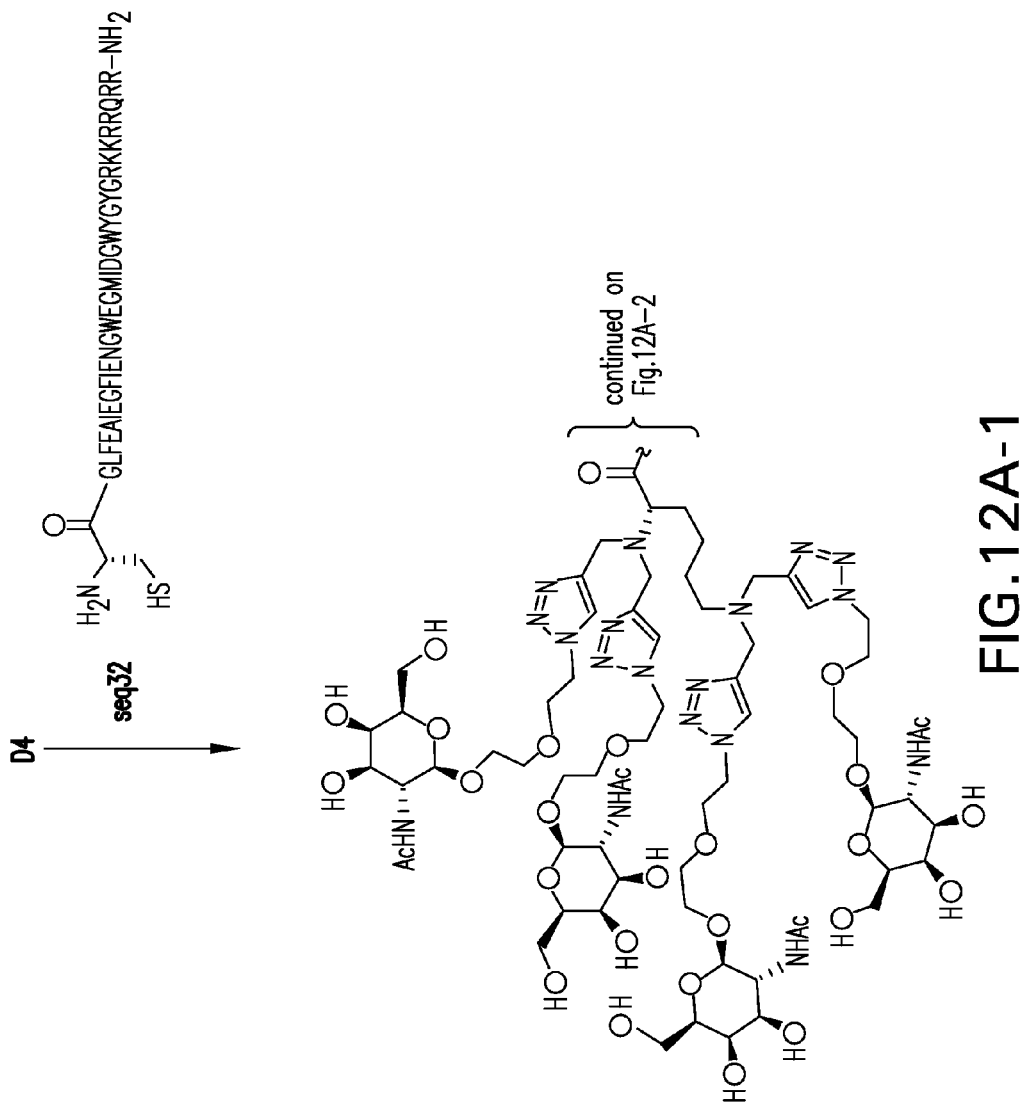
Figures 2, 12A:
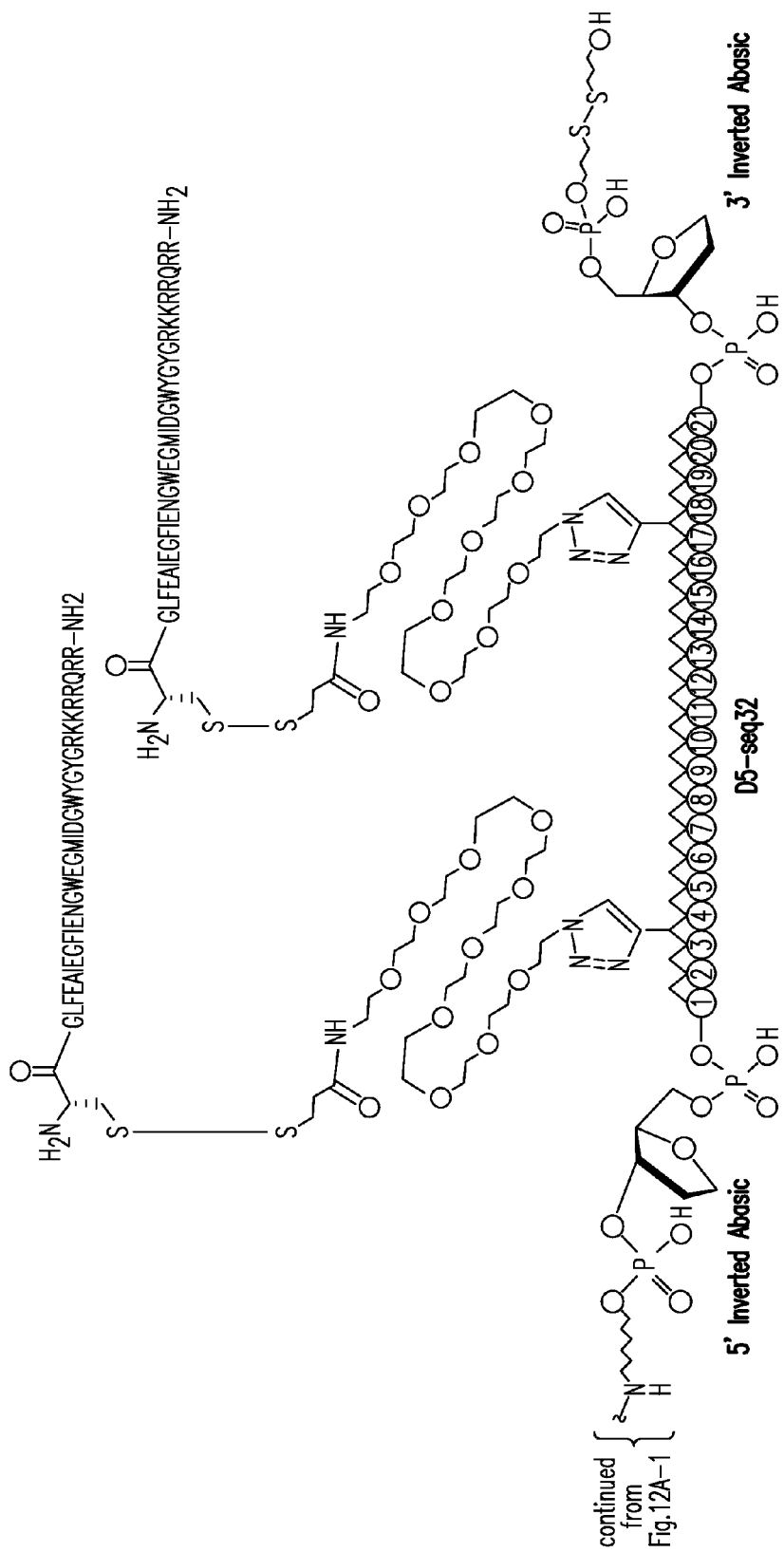
Figures 1, 12B:
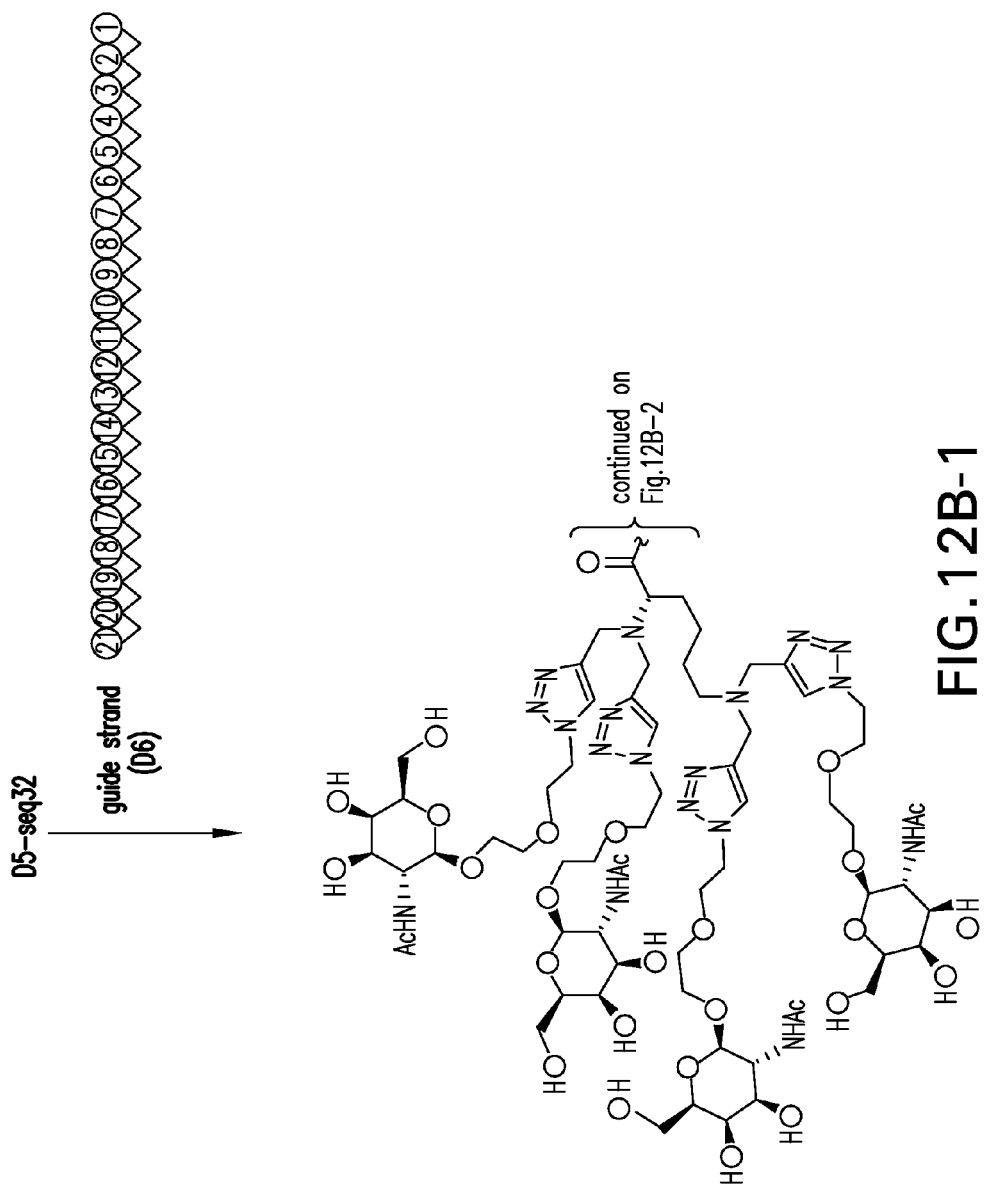
Figures 2, 12B:
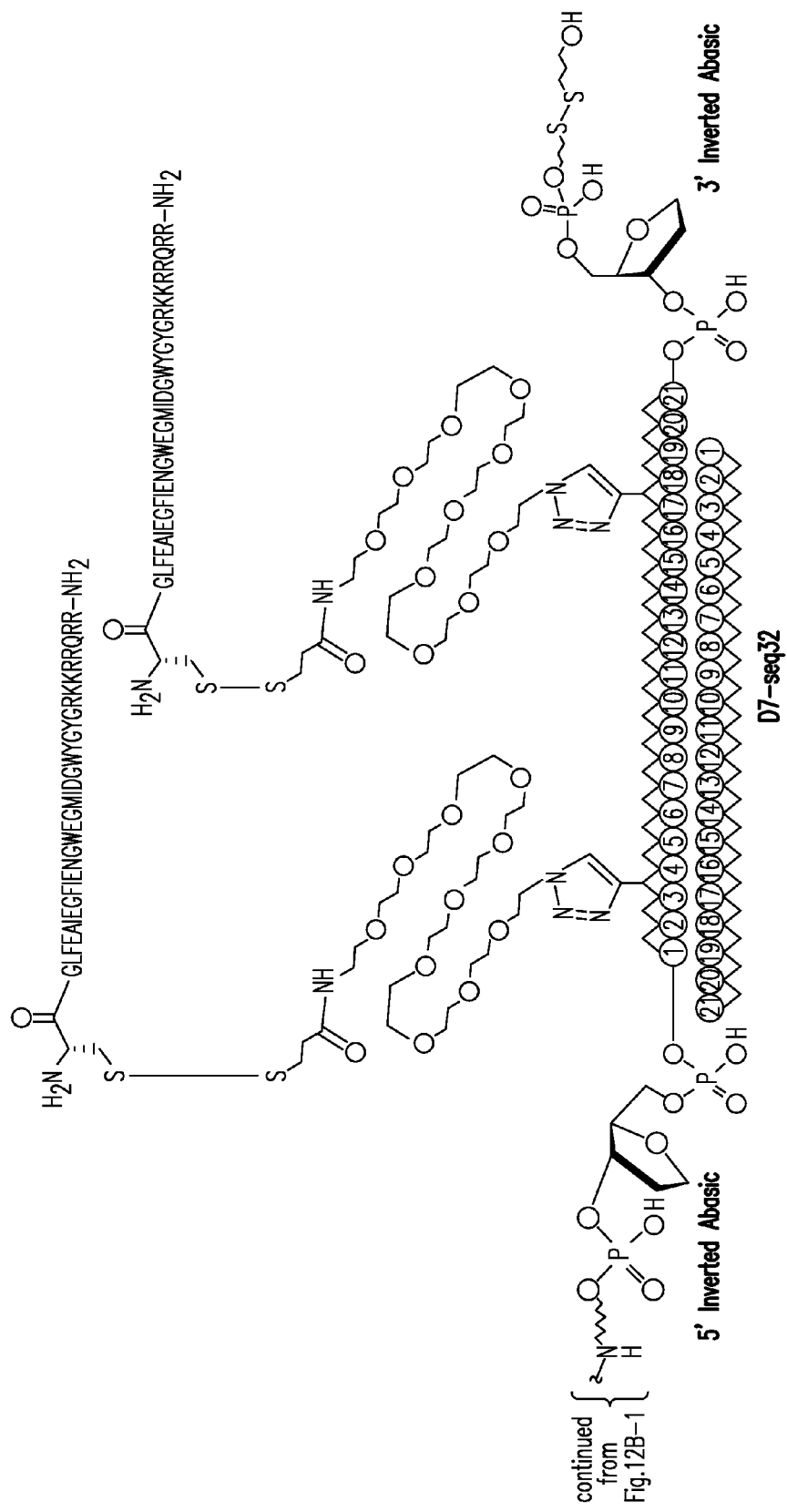
Figure 13A:
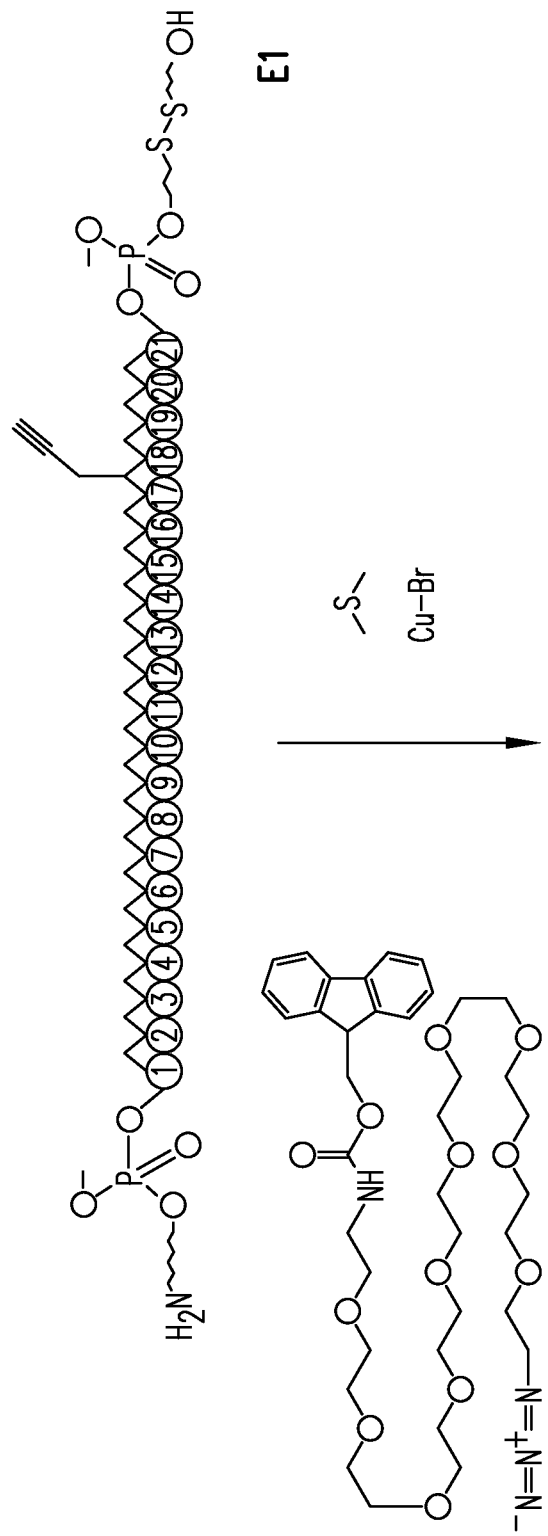
Figure 13B:
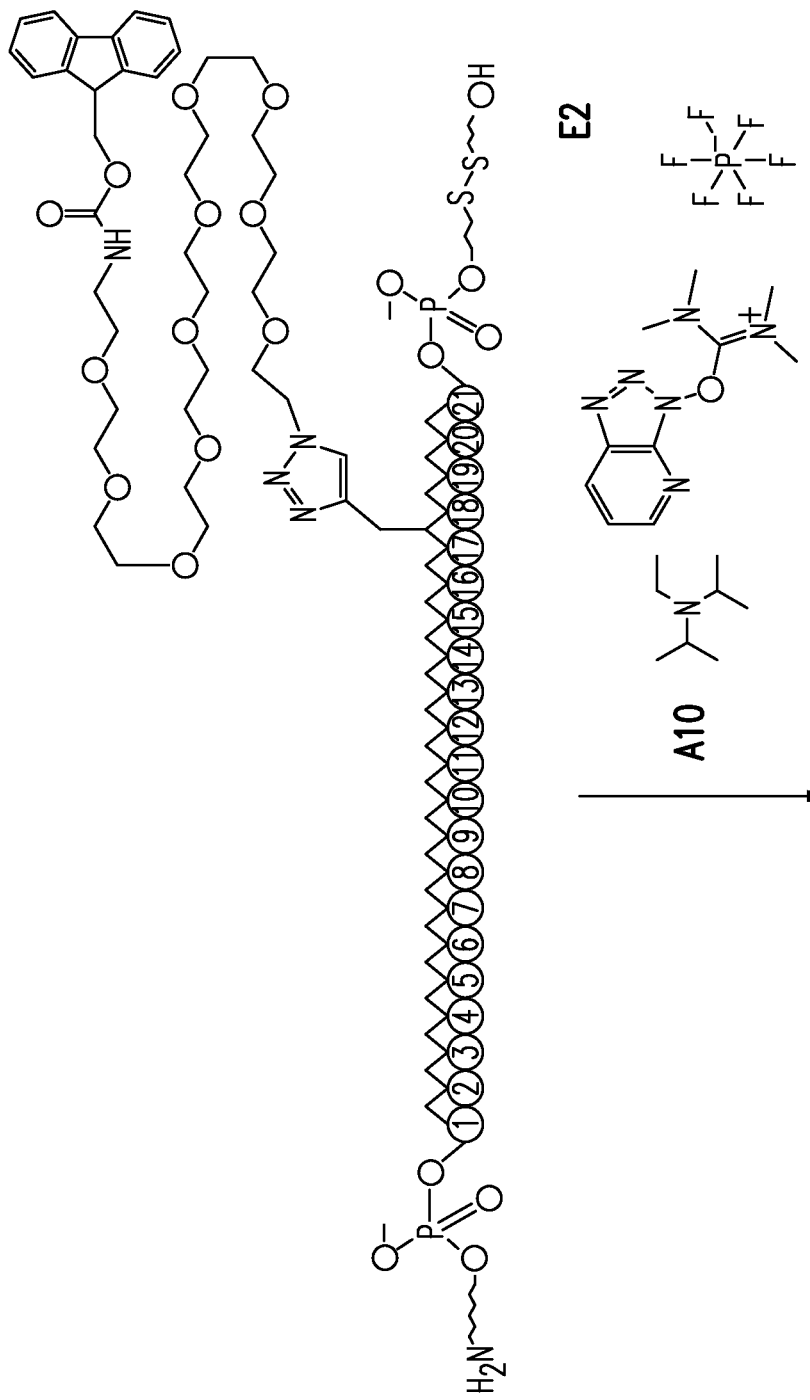
Figure 13C:
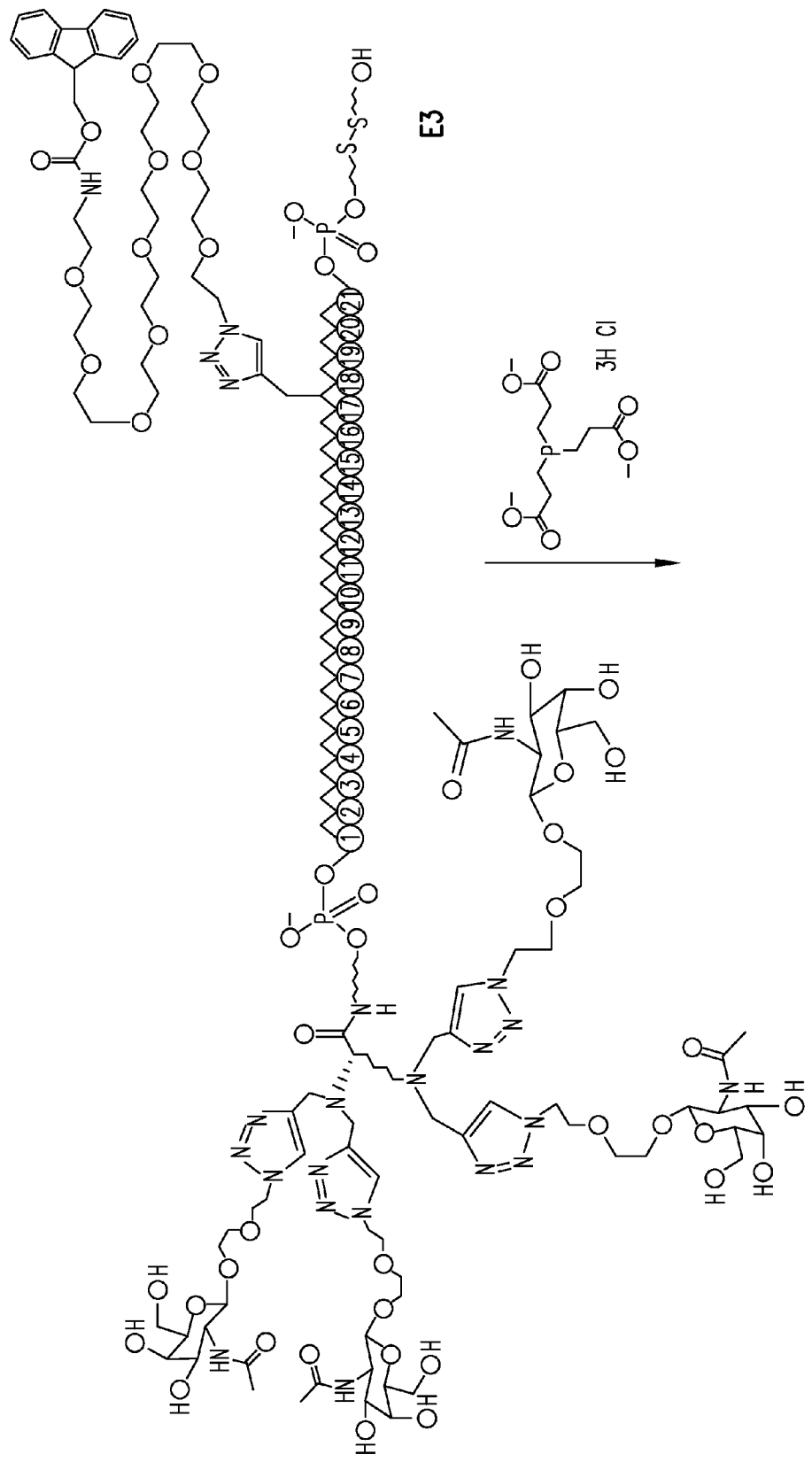
Figure 13D:
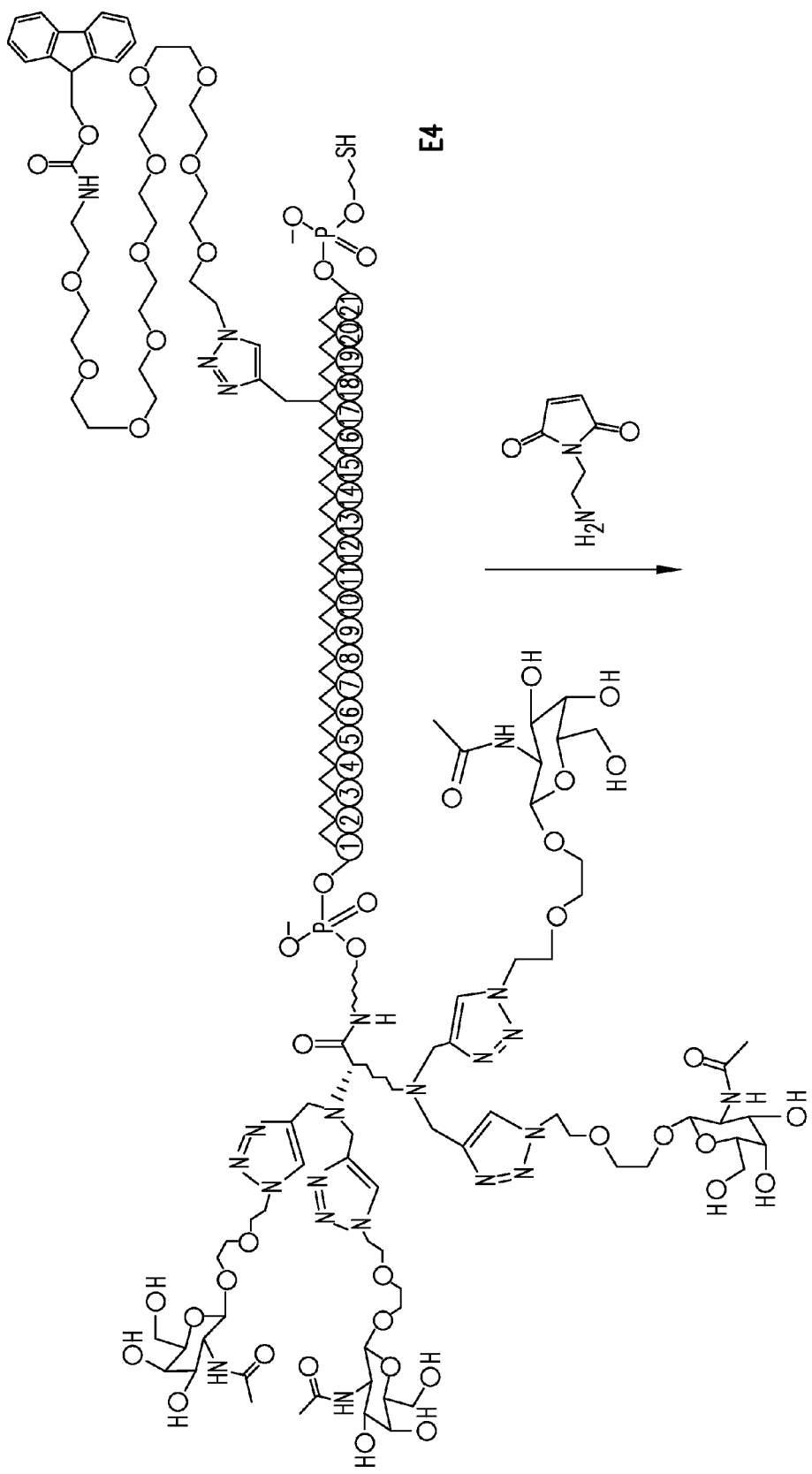
Figures 1, 13E:
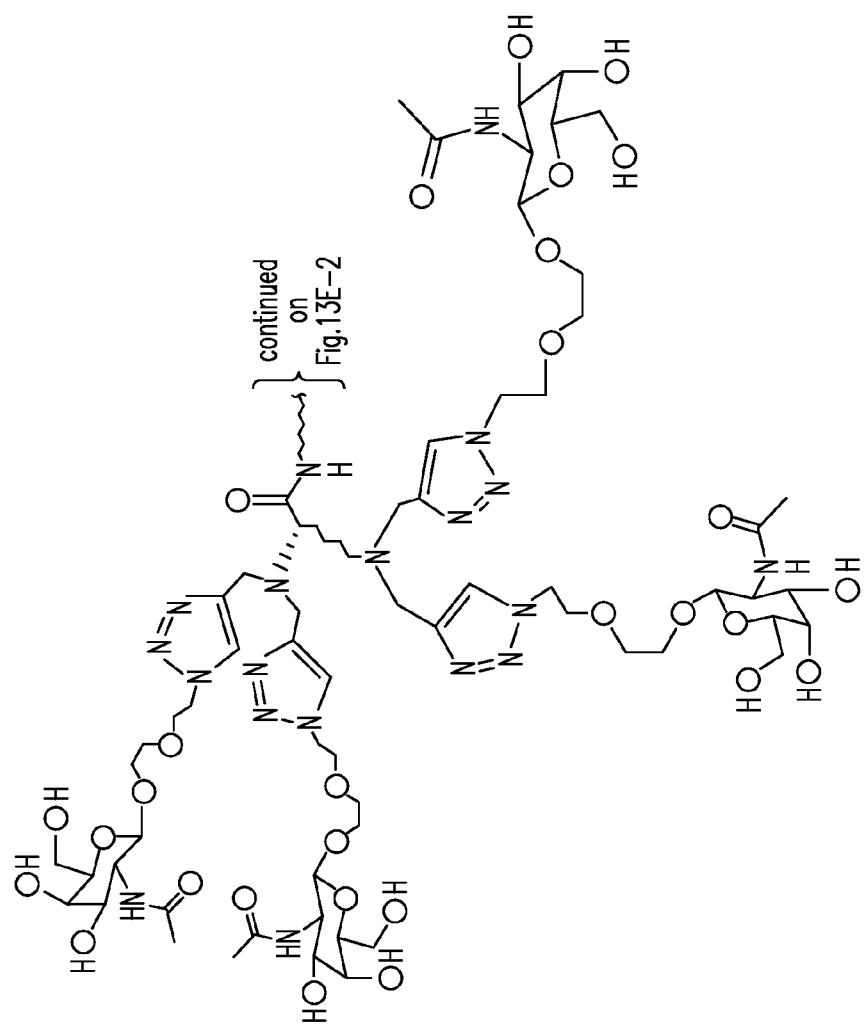
Figures 2, 13E:
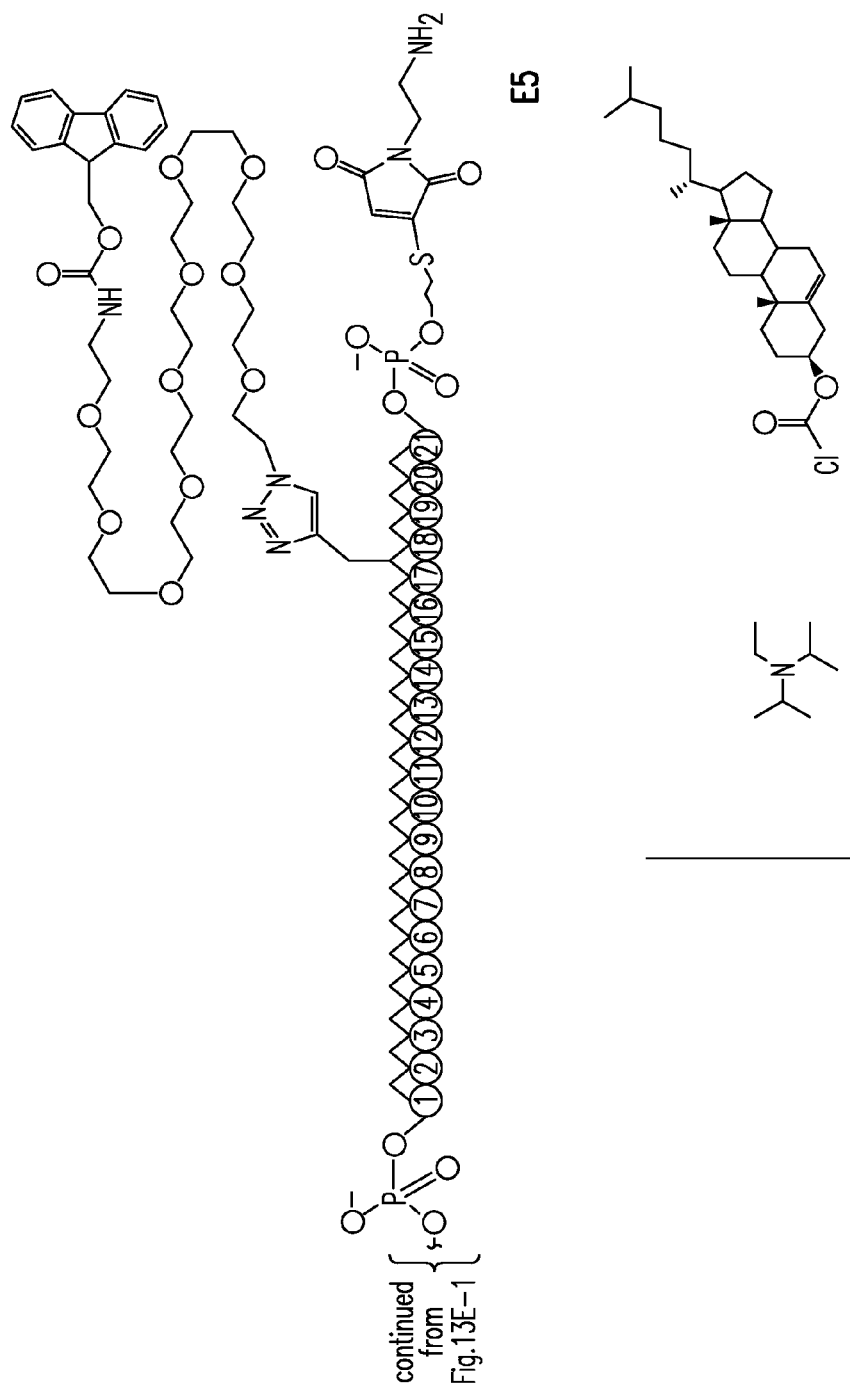
Figures 1, 13F:
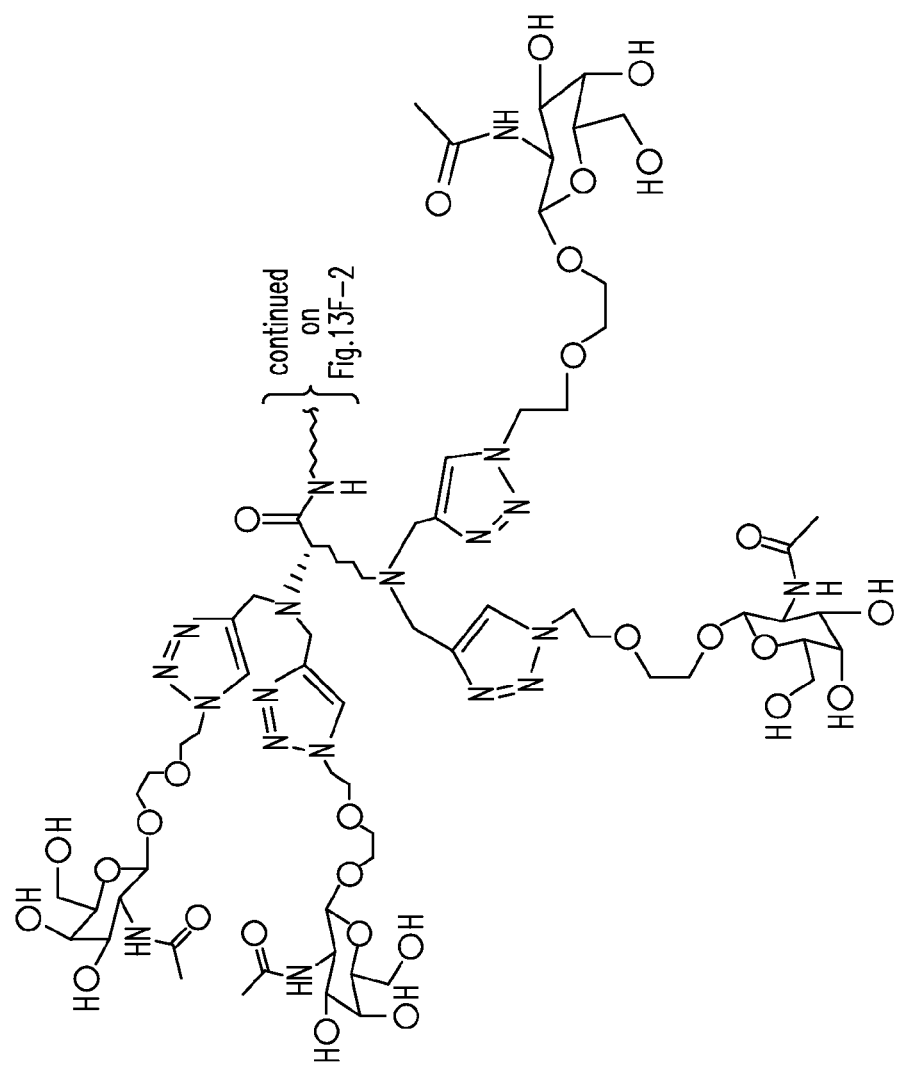
Figures 2, 13F:
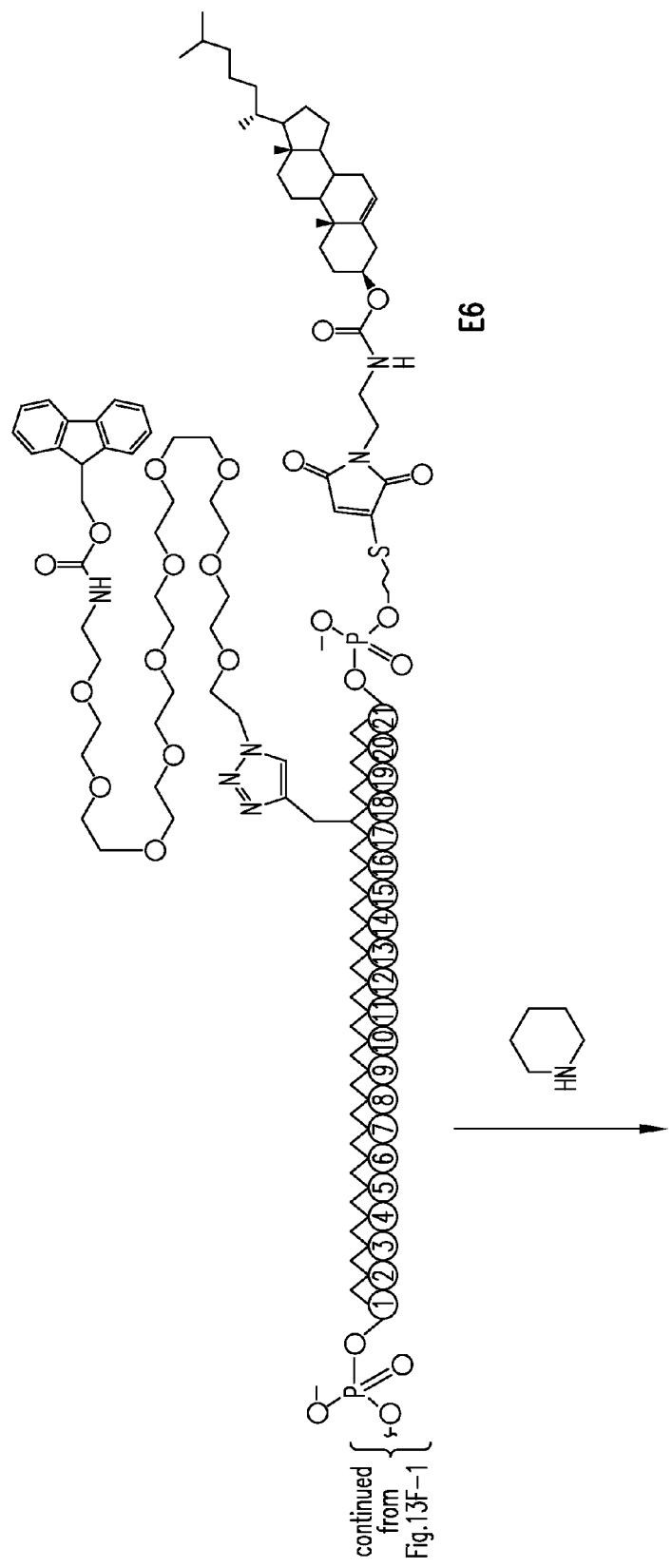
Figures 1, 13G:
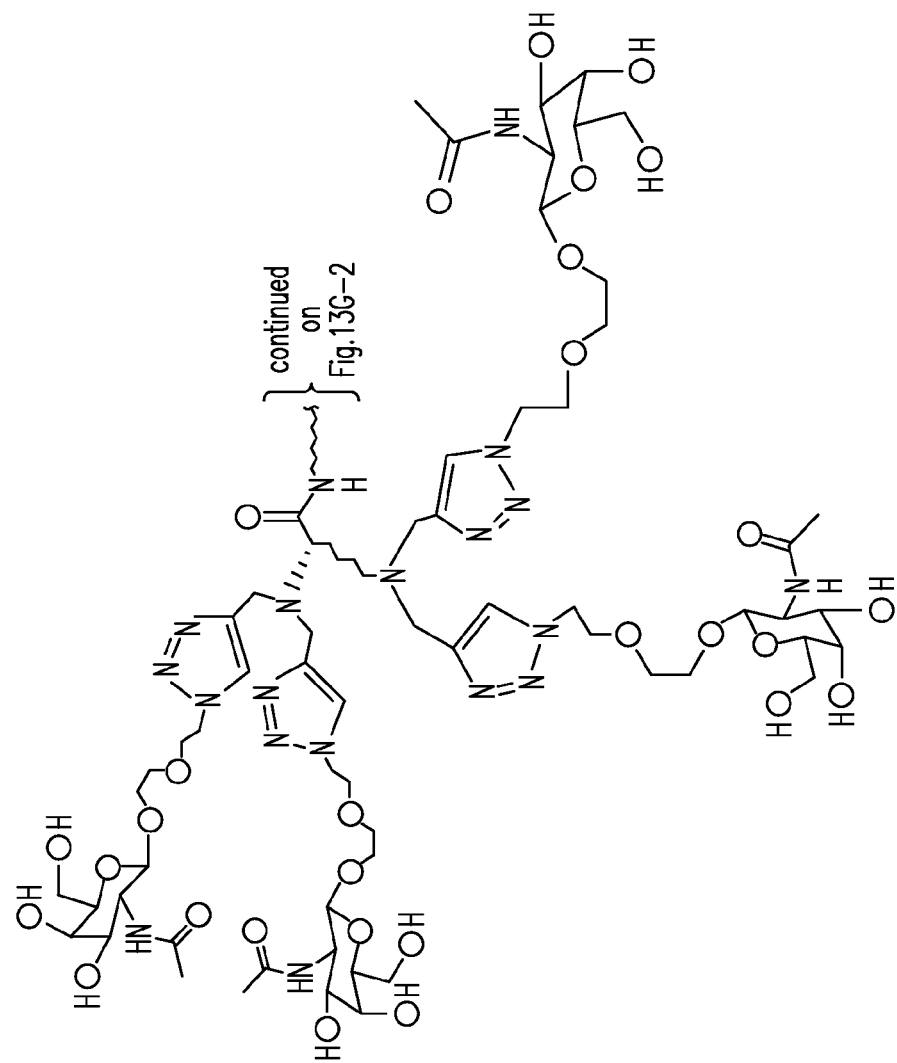
Figures 2, 13G:
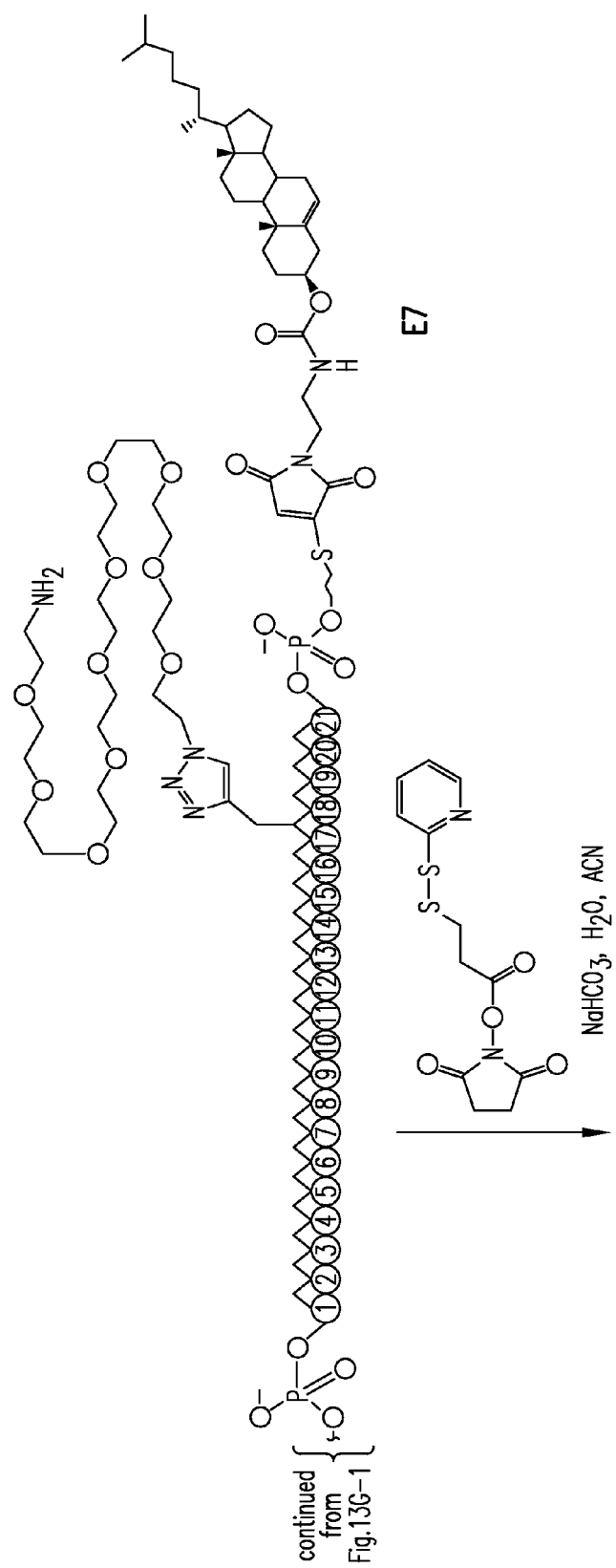
Figures 1, 13H:
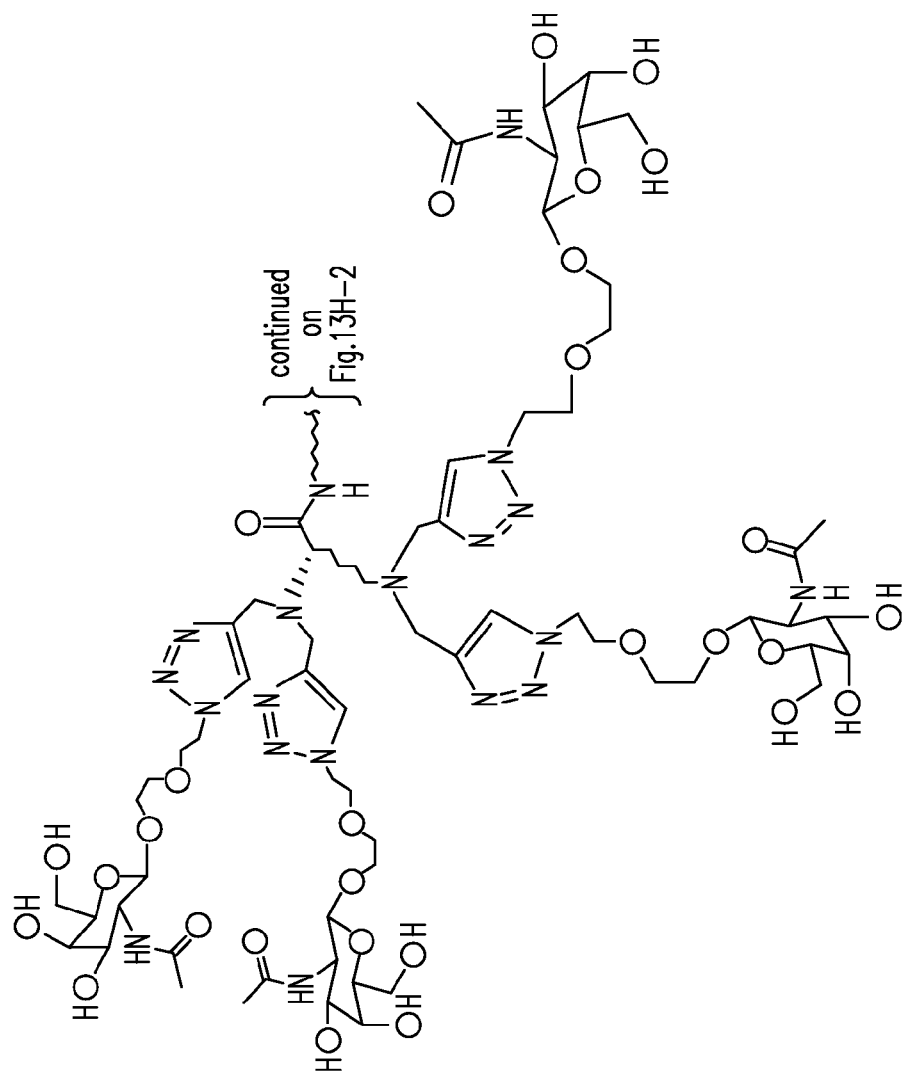
Figures 2, 13H:
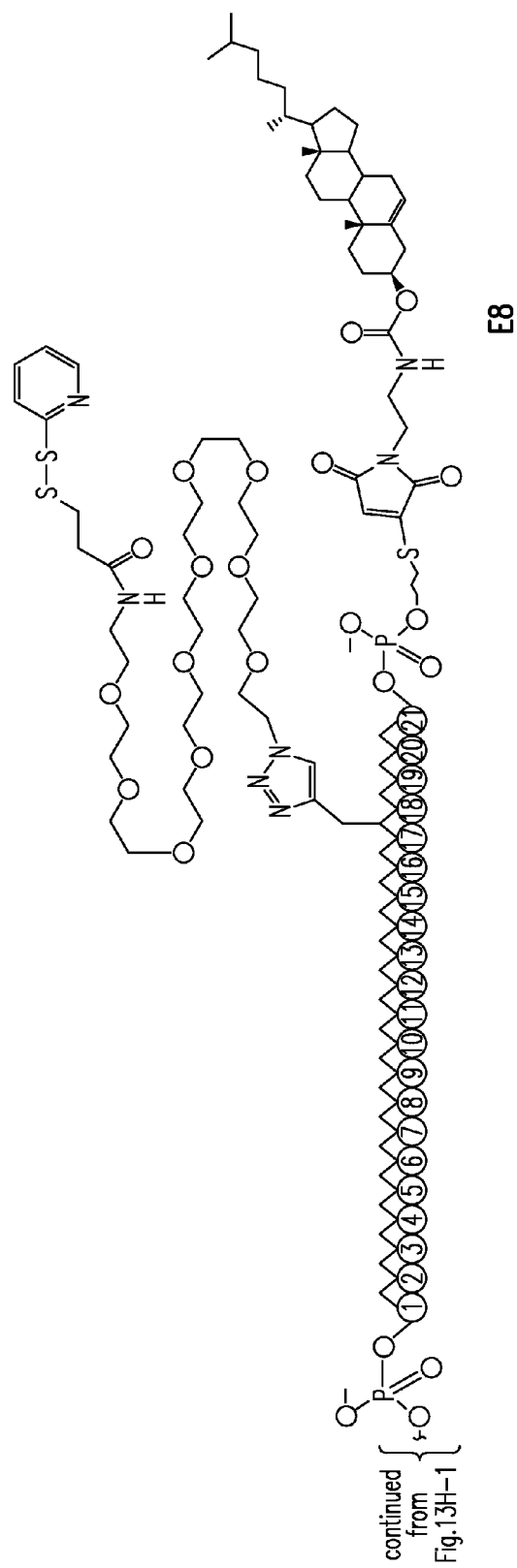
Figures 1, 14A:
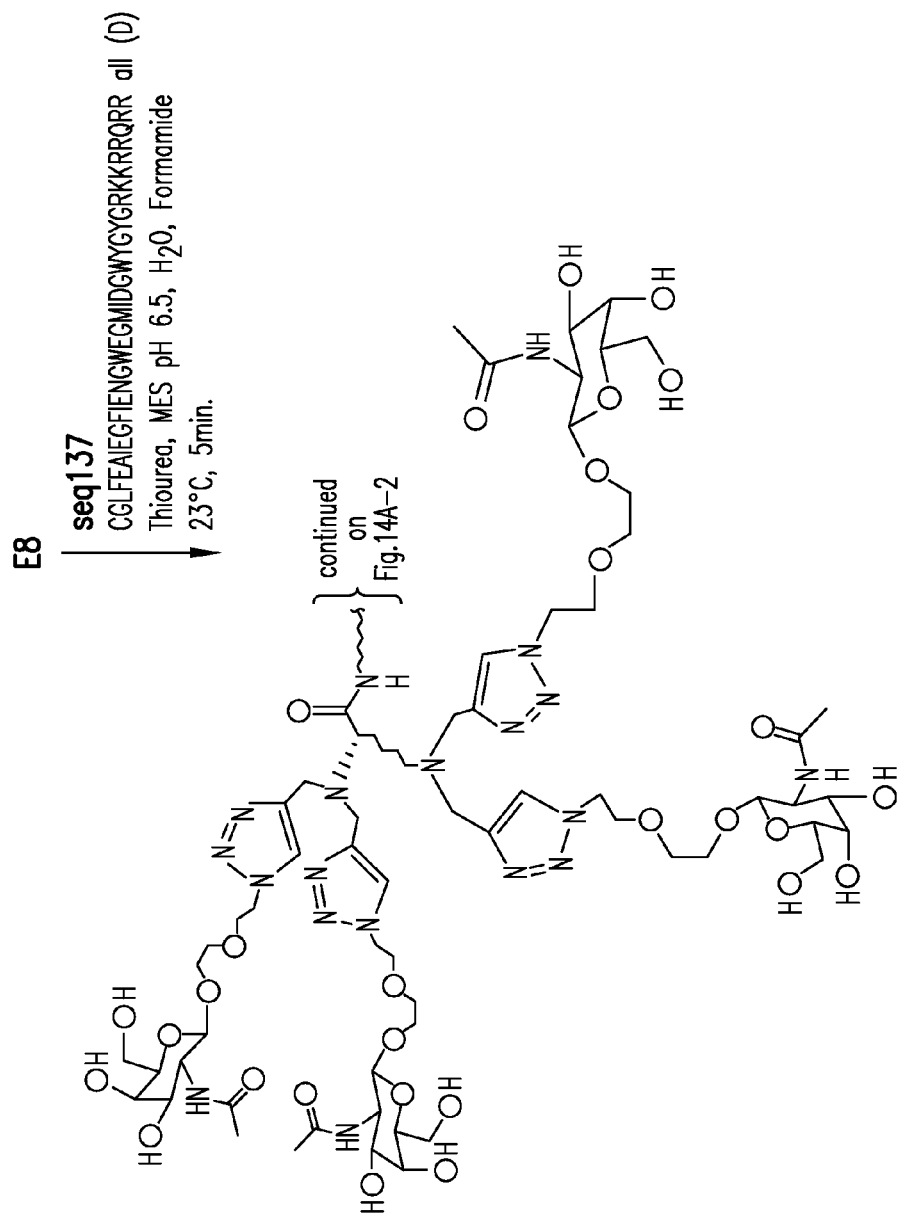
Figures 2, 14A:
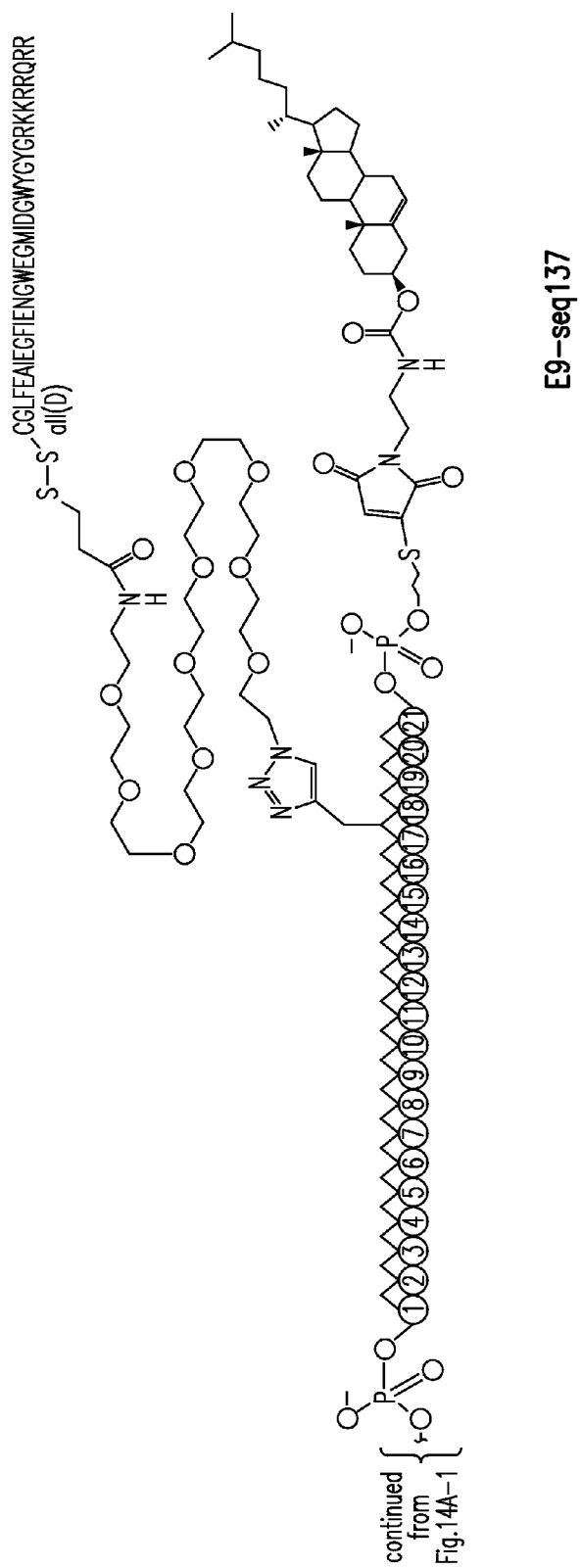
Figures 1, 14B:
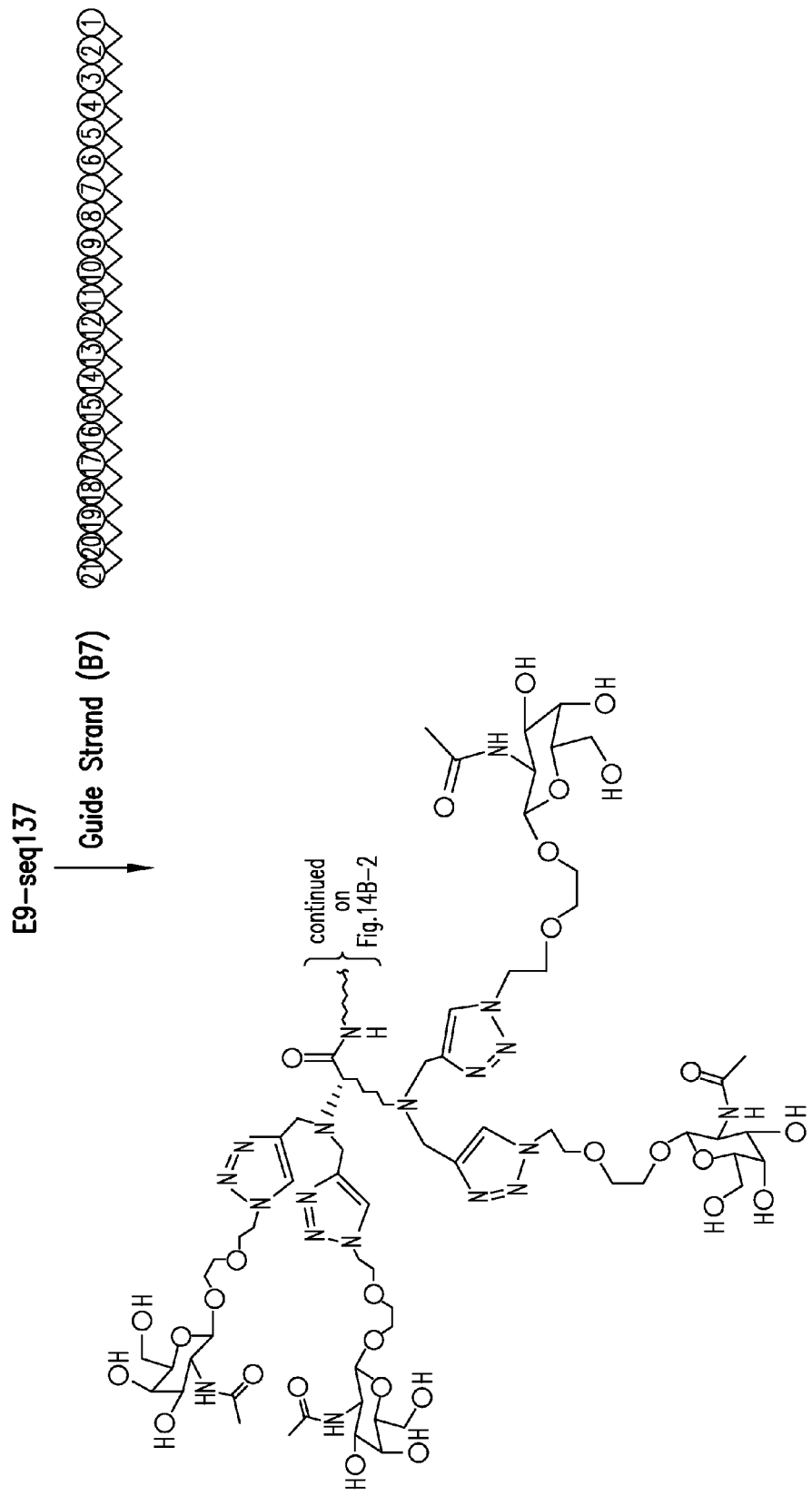
Figures 2, 14B:
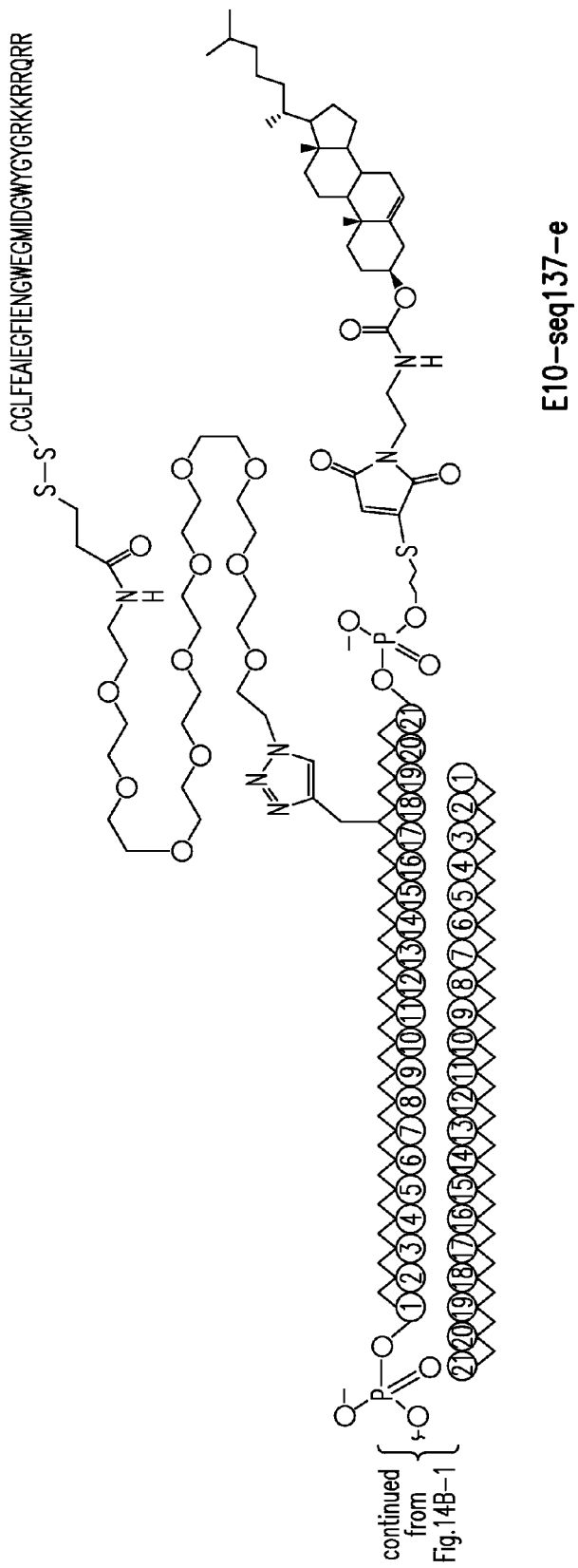
Figure 15A:
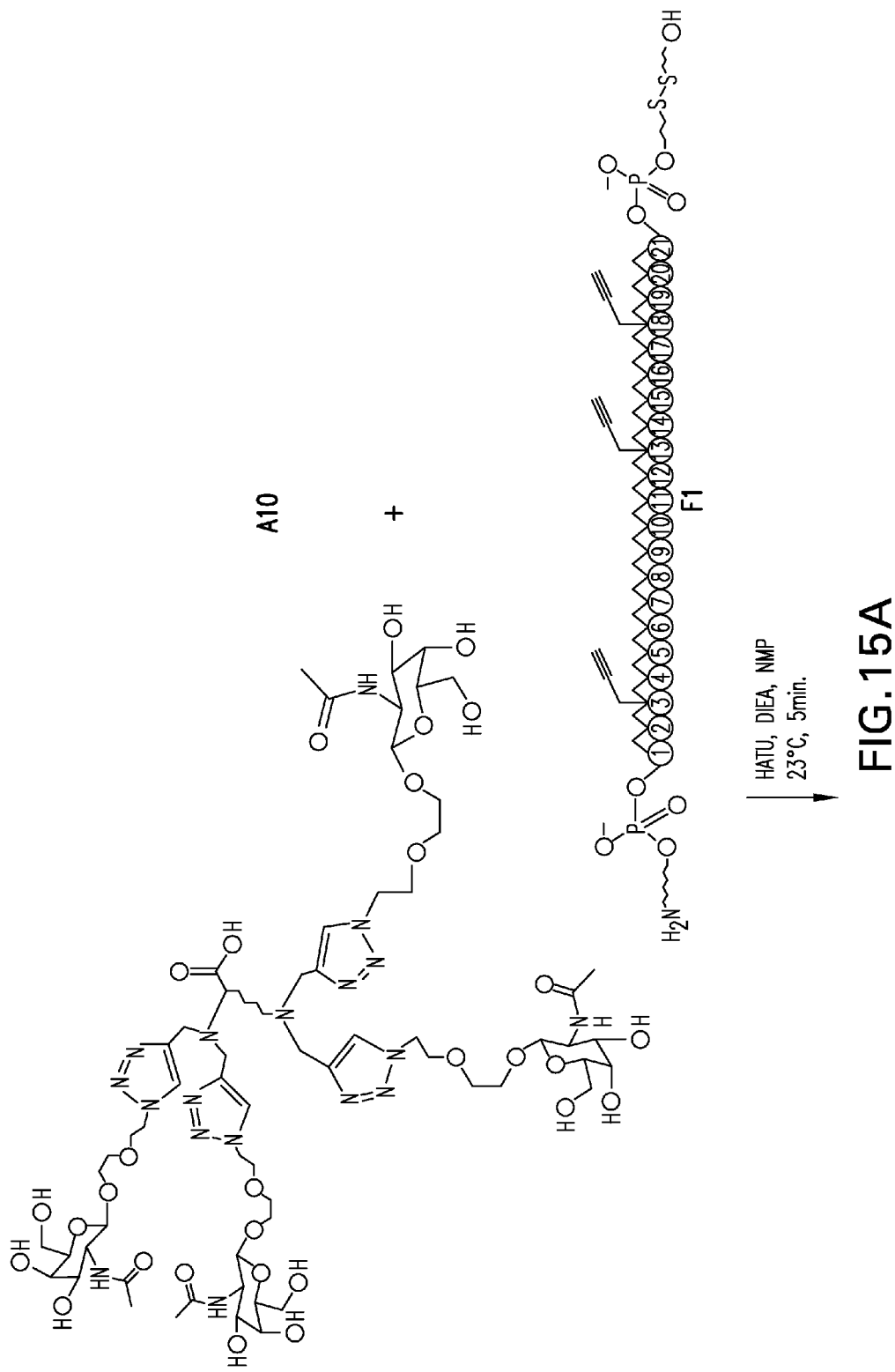
Figure 15B:
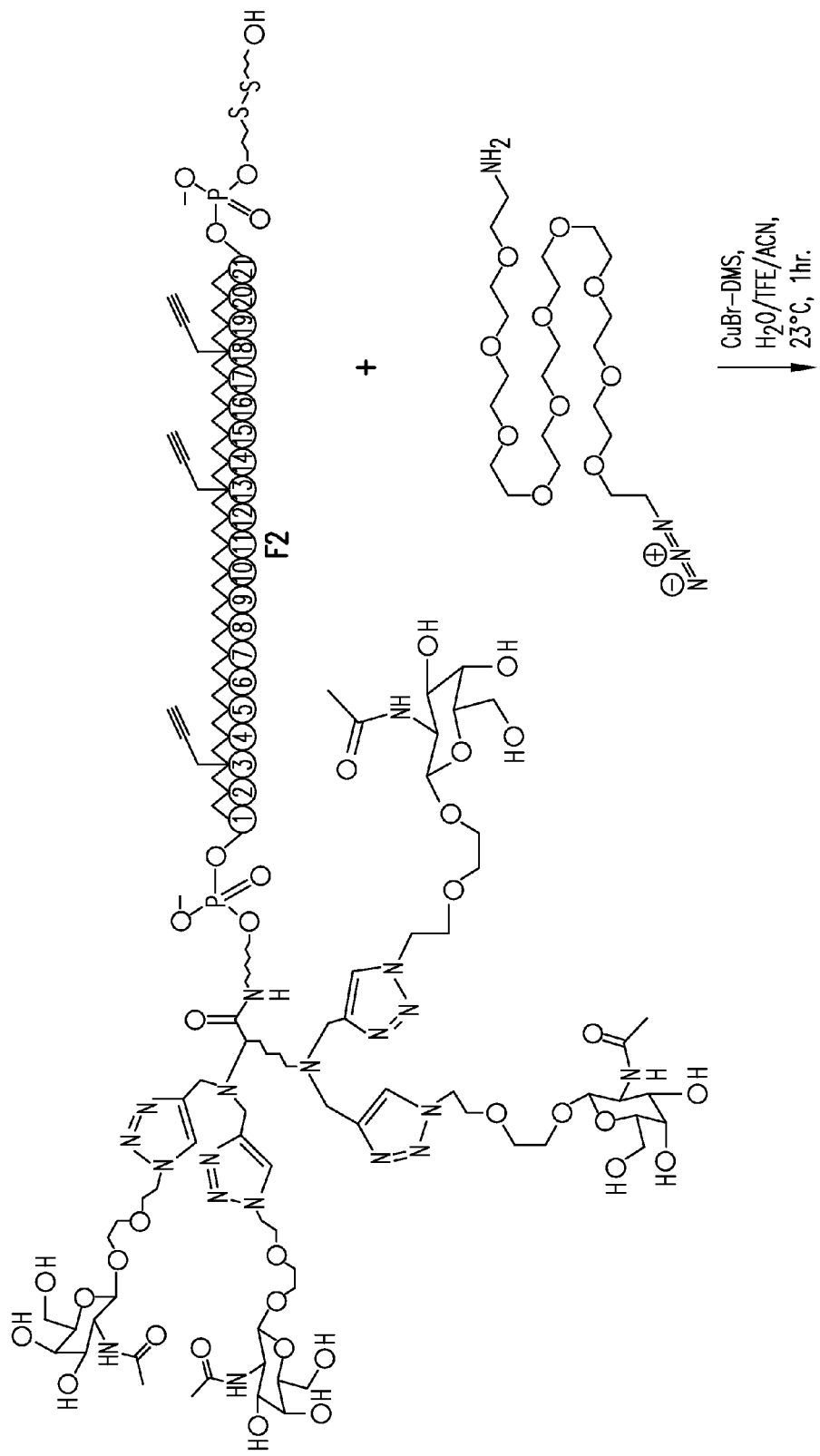
Figures 1, 15C:
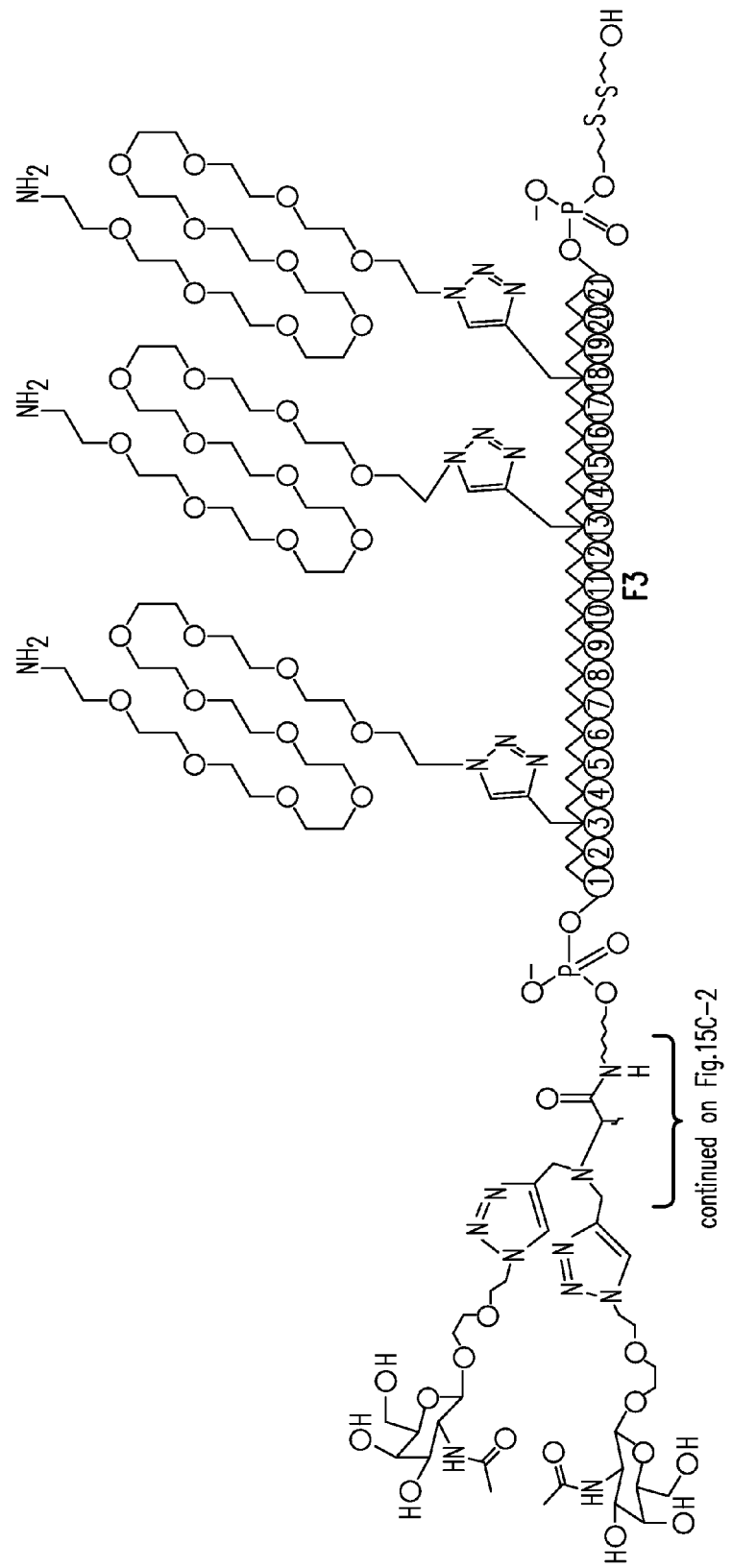
Figures 2, 15C:
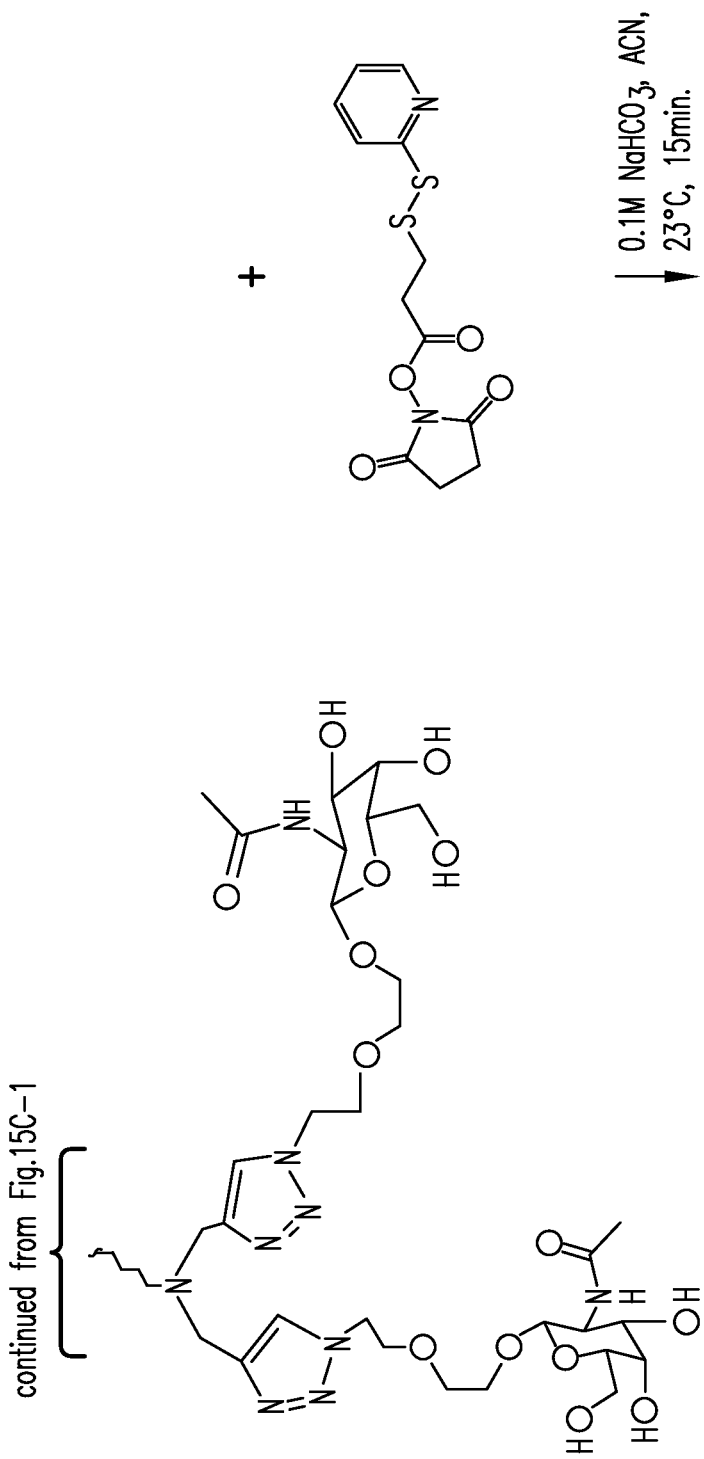
Figures 1, 15D:
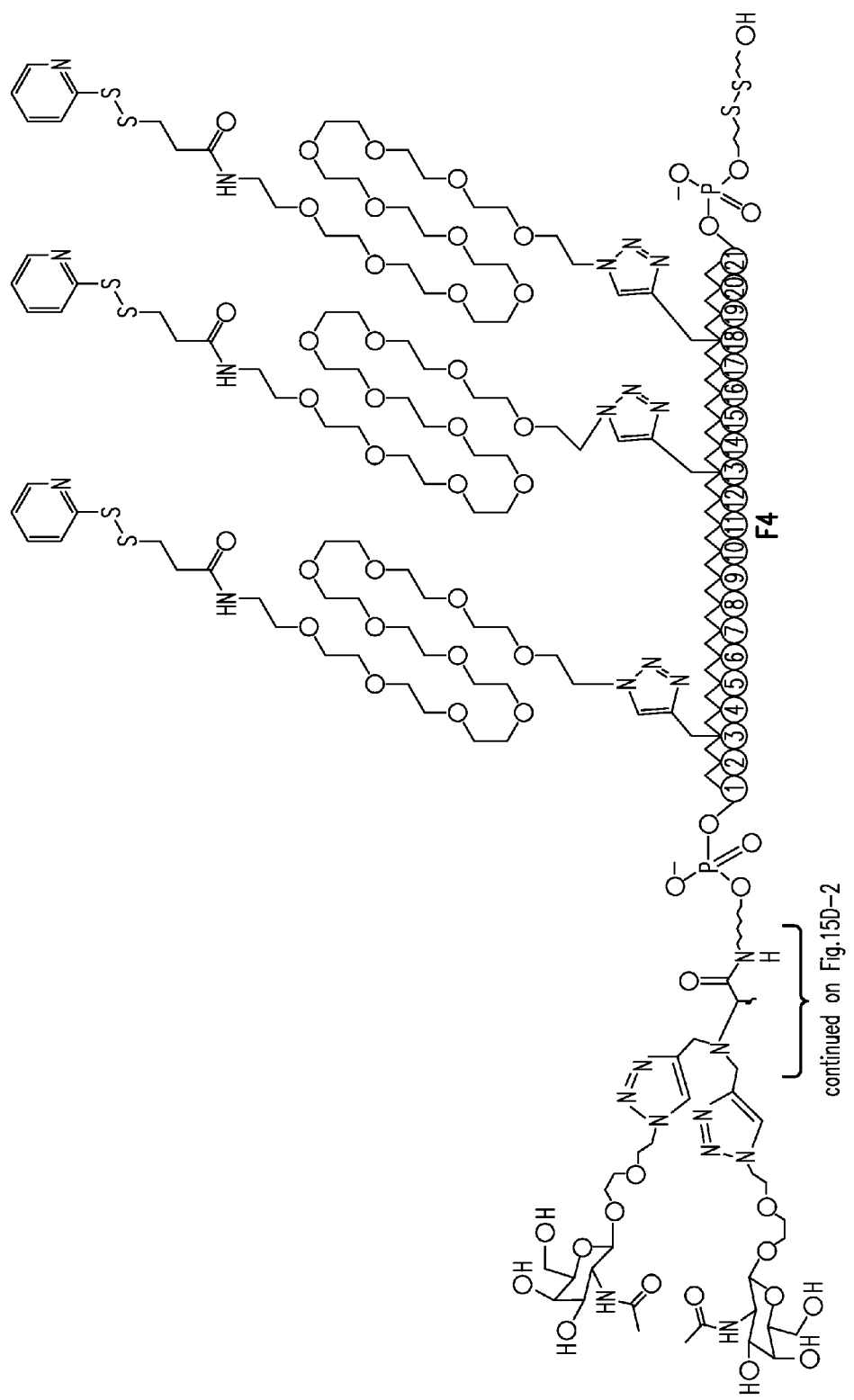
Figures 2, 15D:
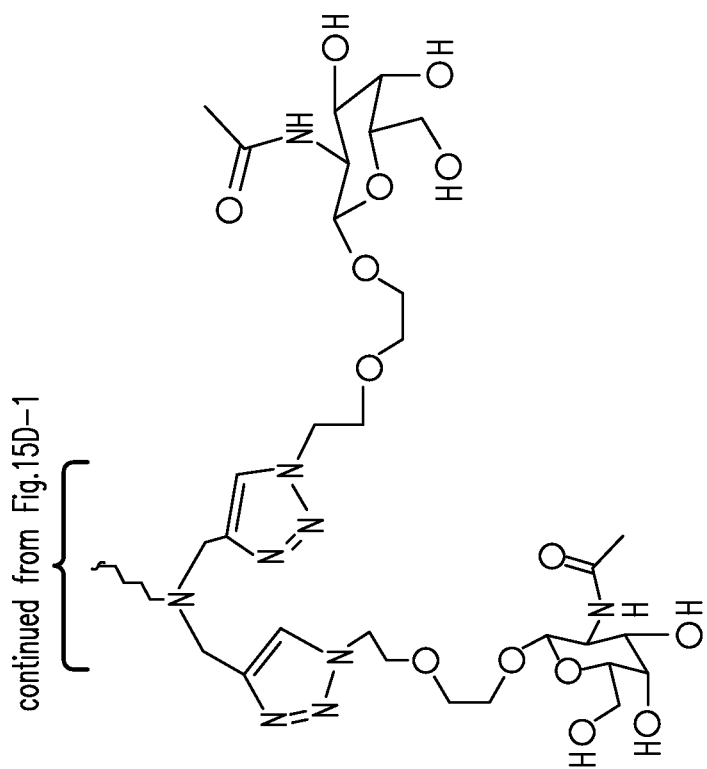
Figures 1, 15E:
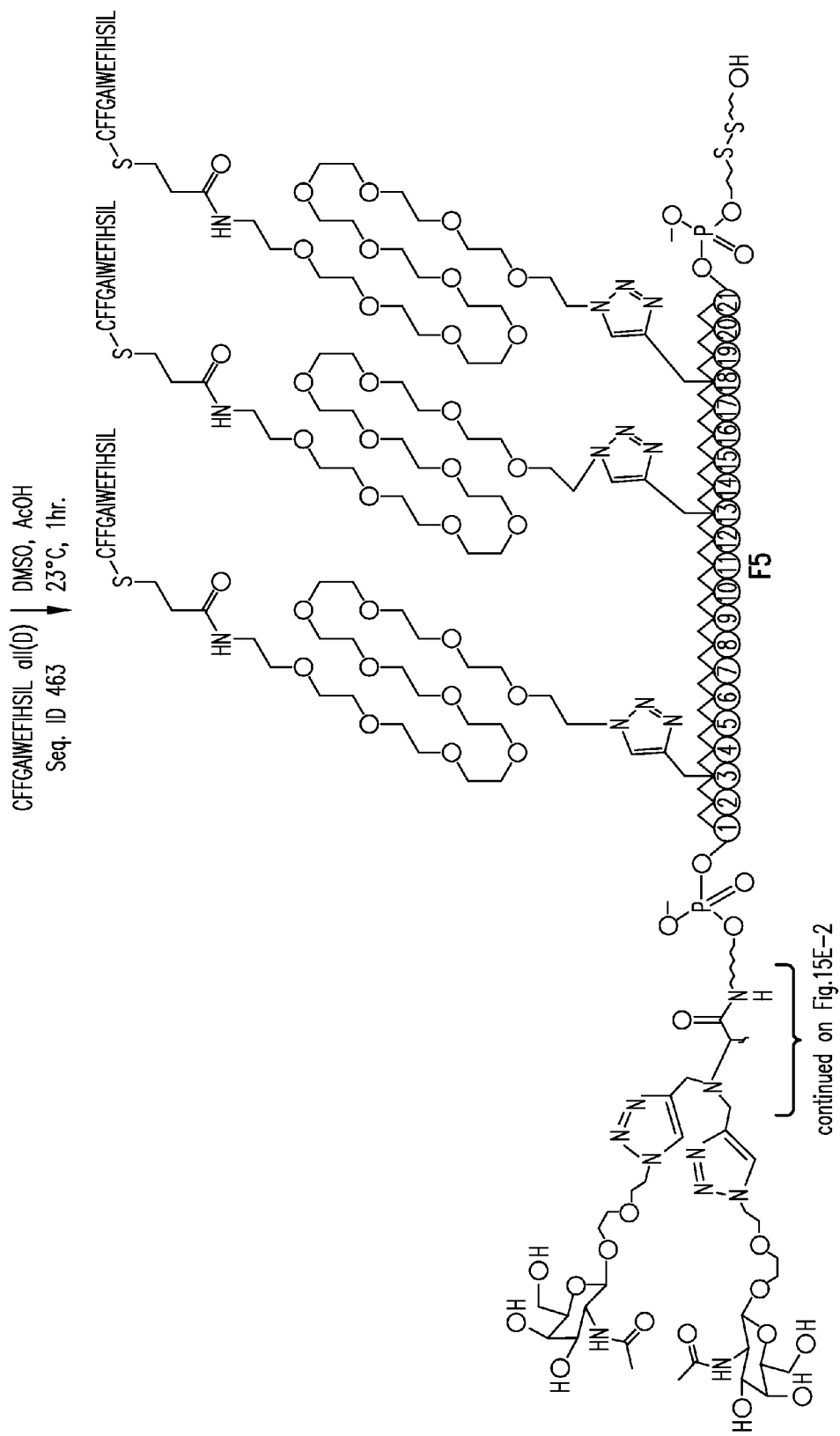
Figures 2, 15E:
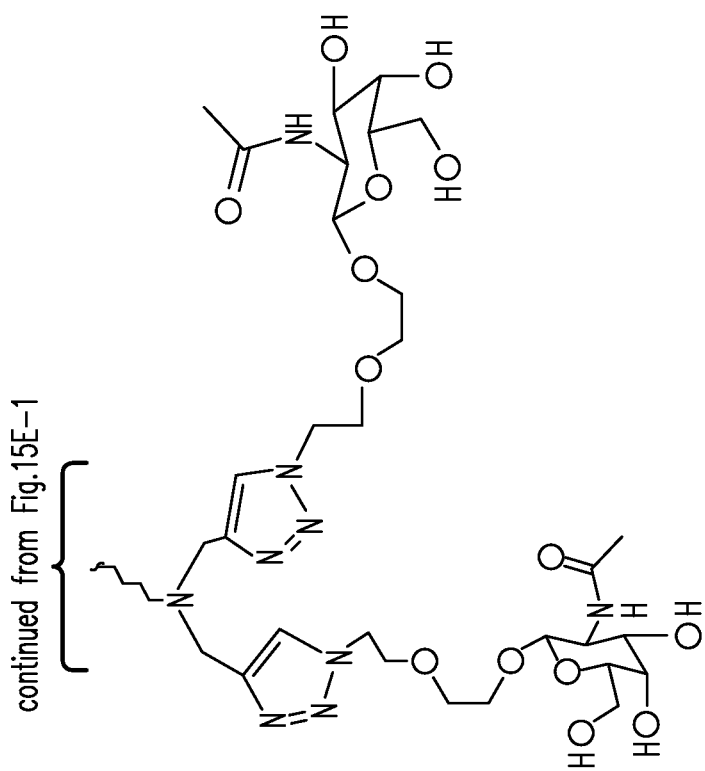
Figures 1, 16A:
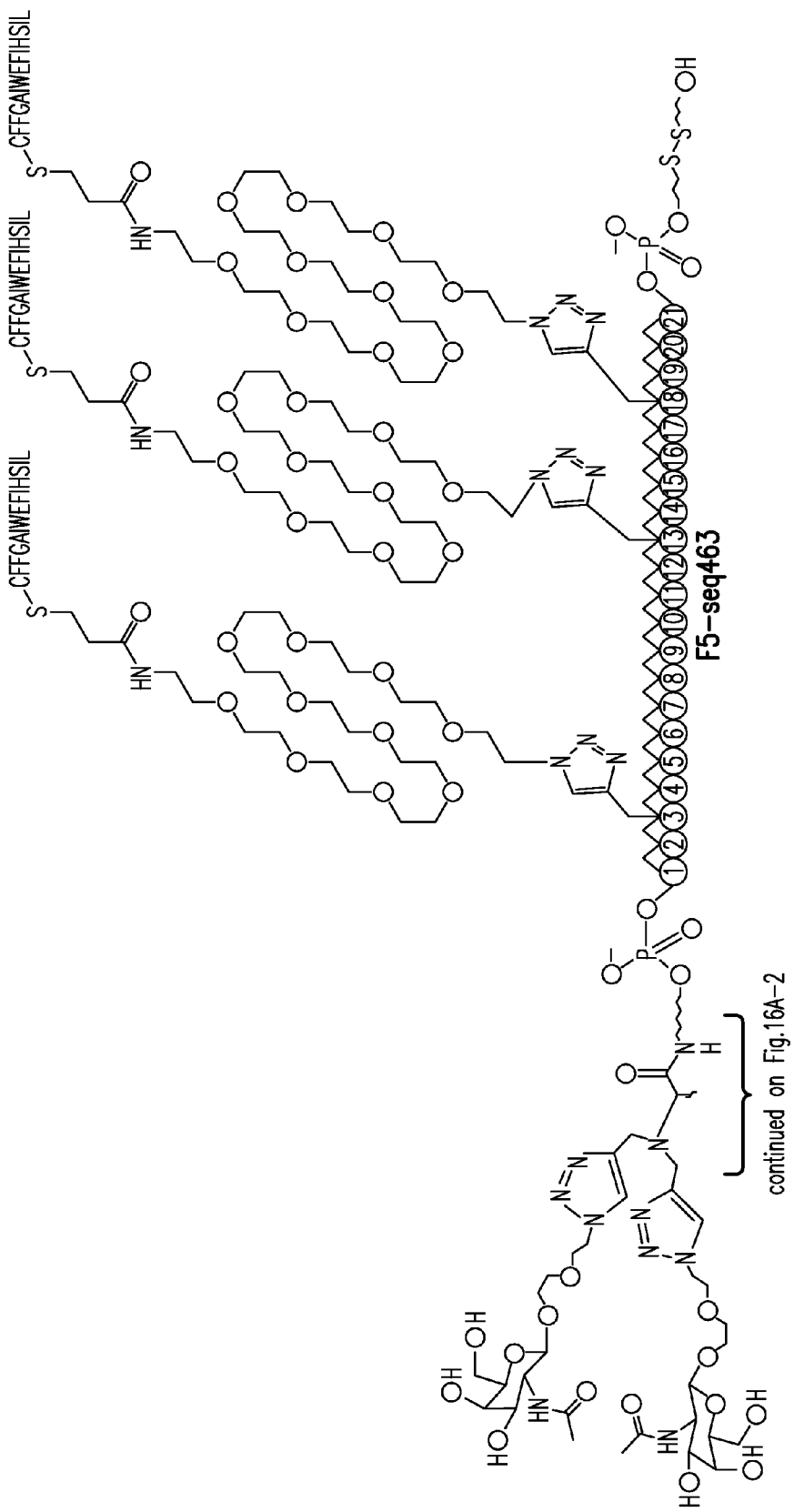
Figures 2, 16A:
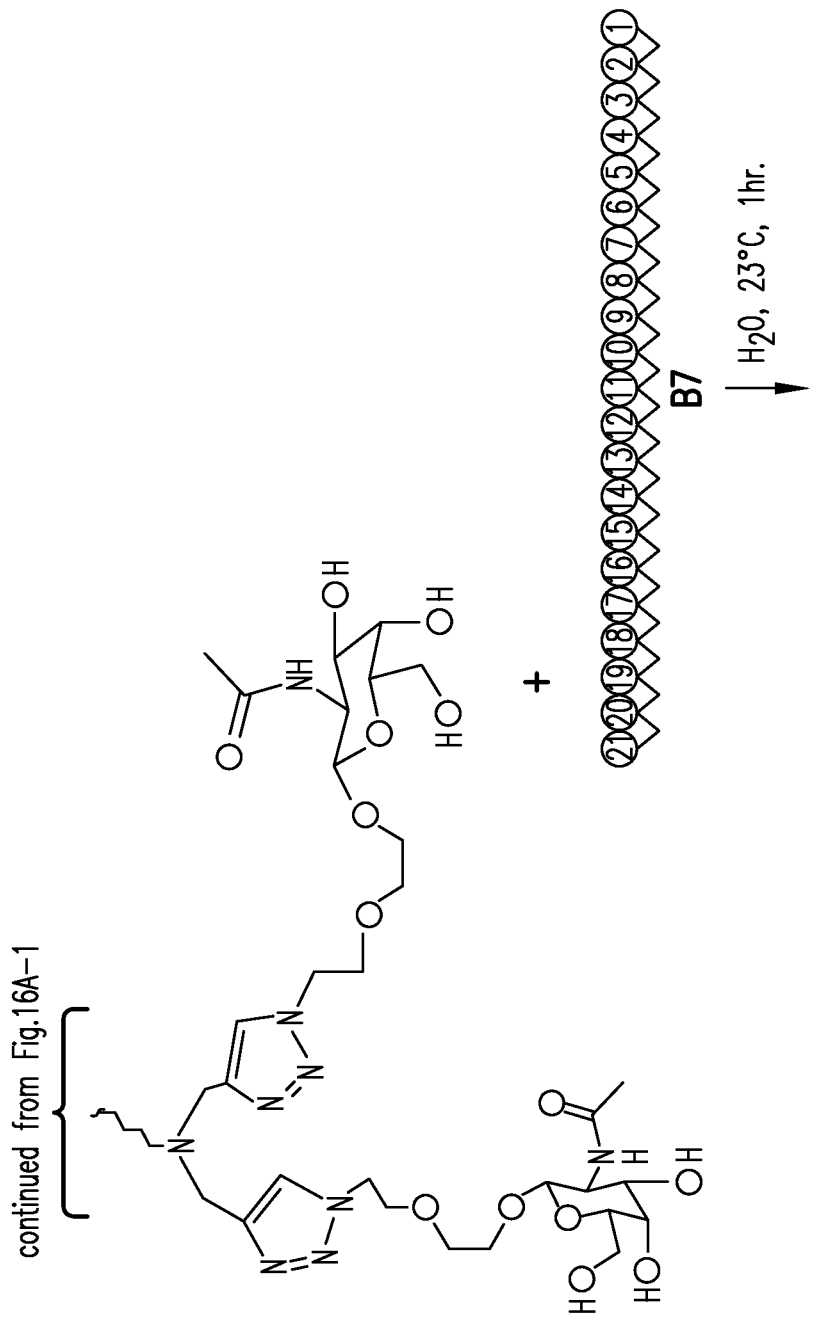
Figures 1, 16B:
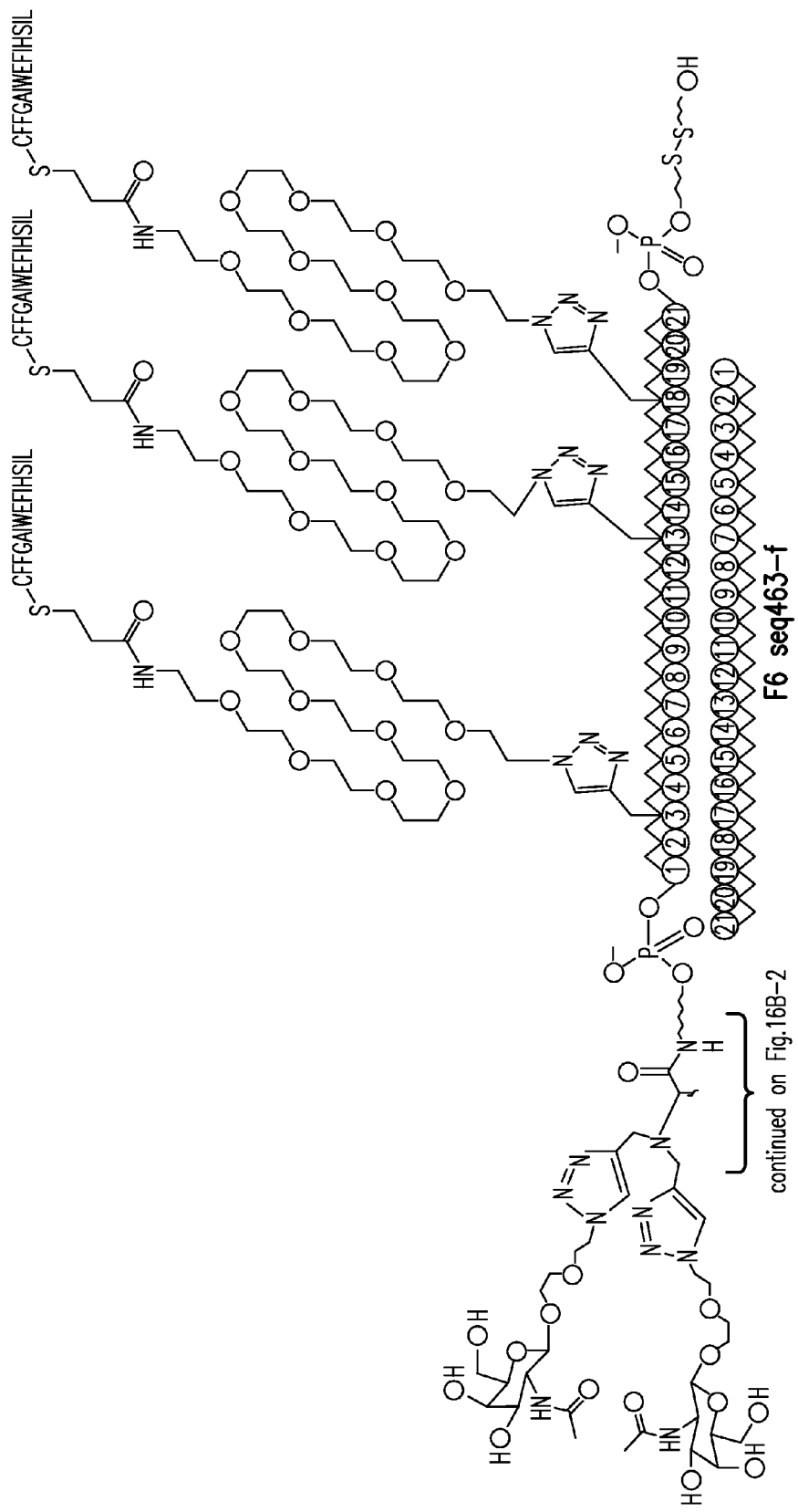
Figures 2, 16B:
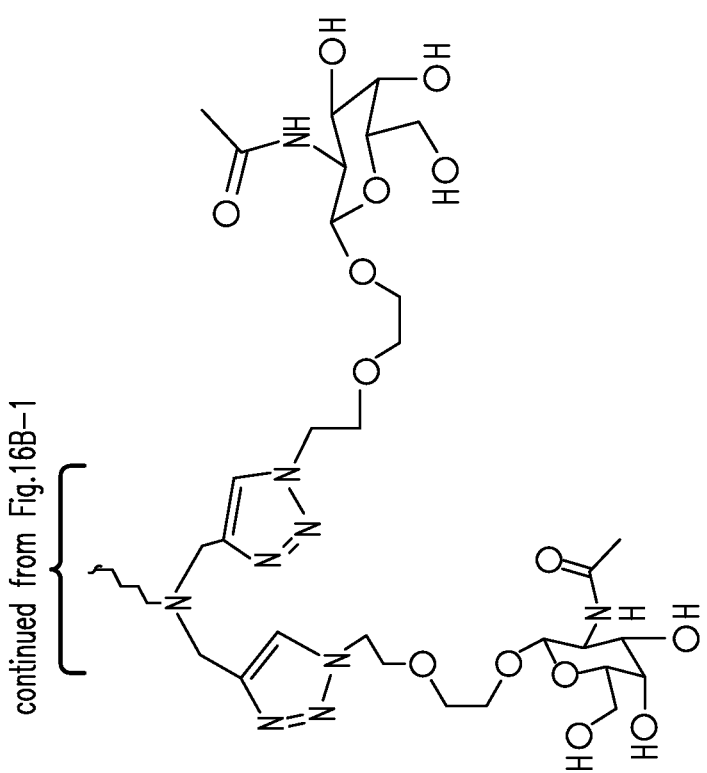
Figures 1, 17A:
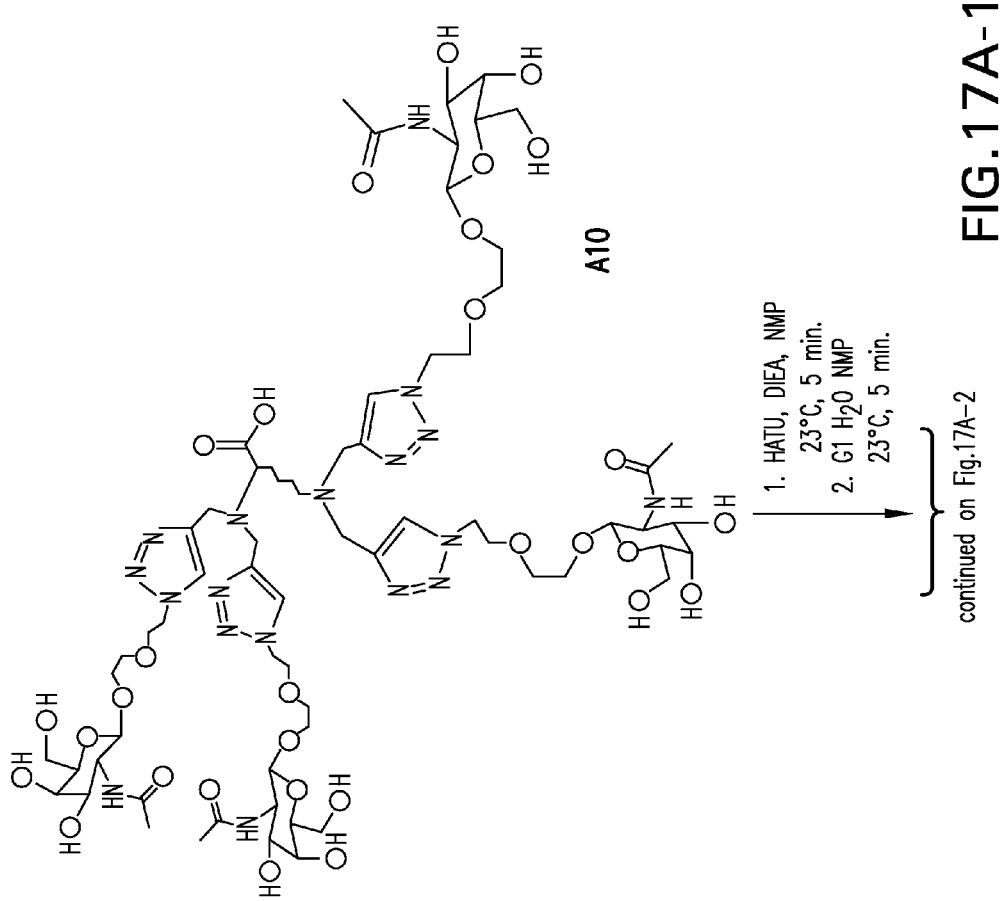
Figures 2, 17A:
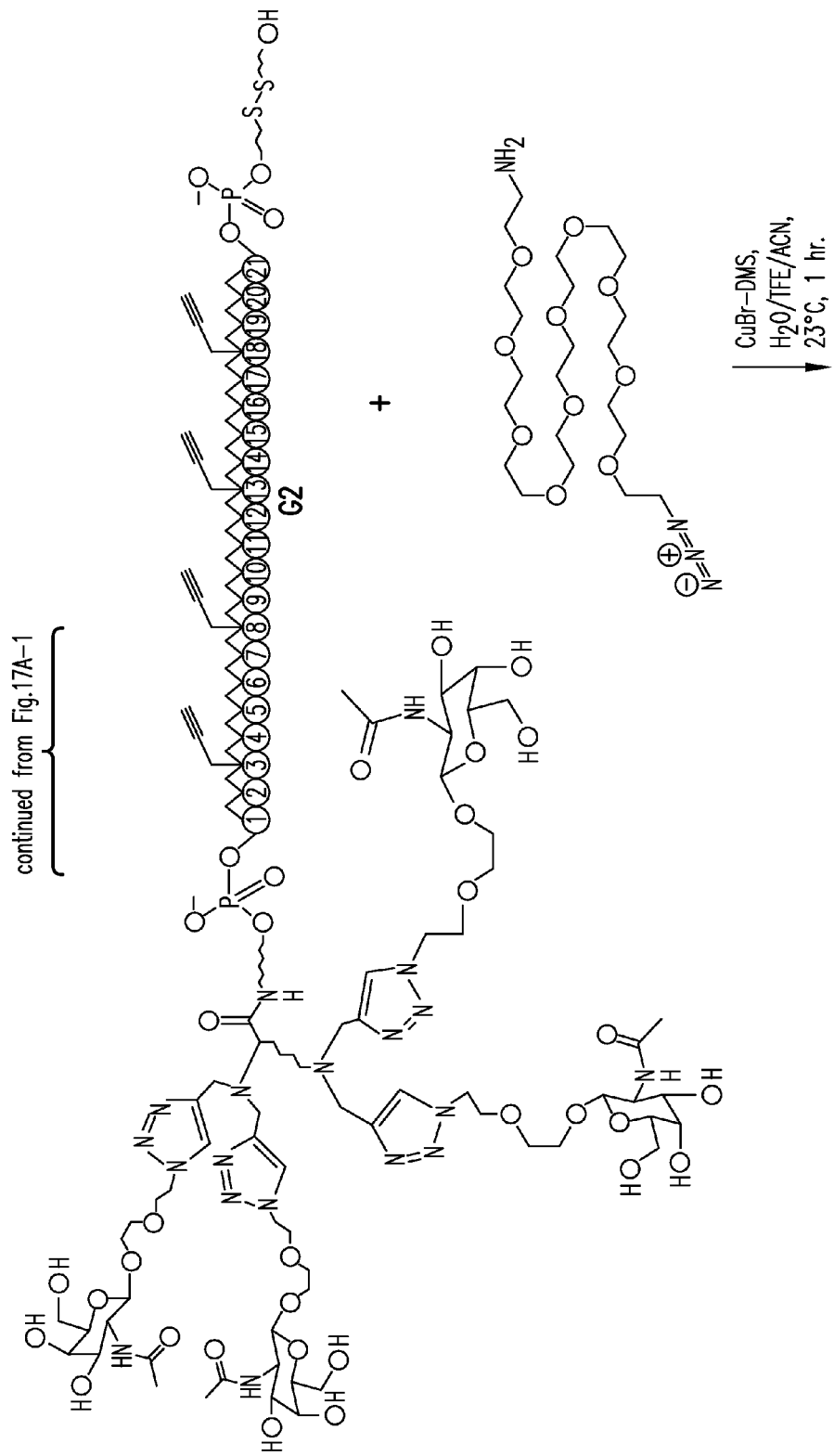
Figure 17B:
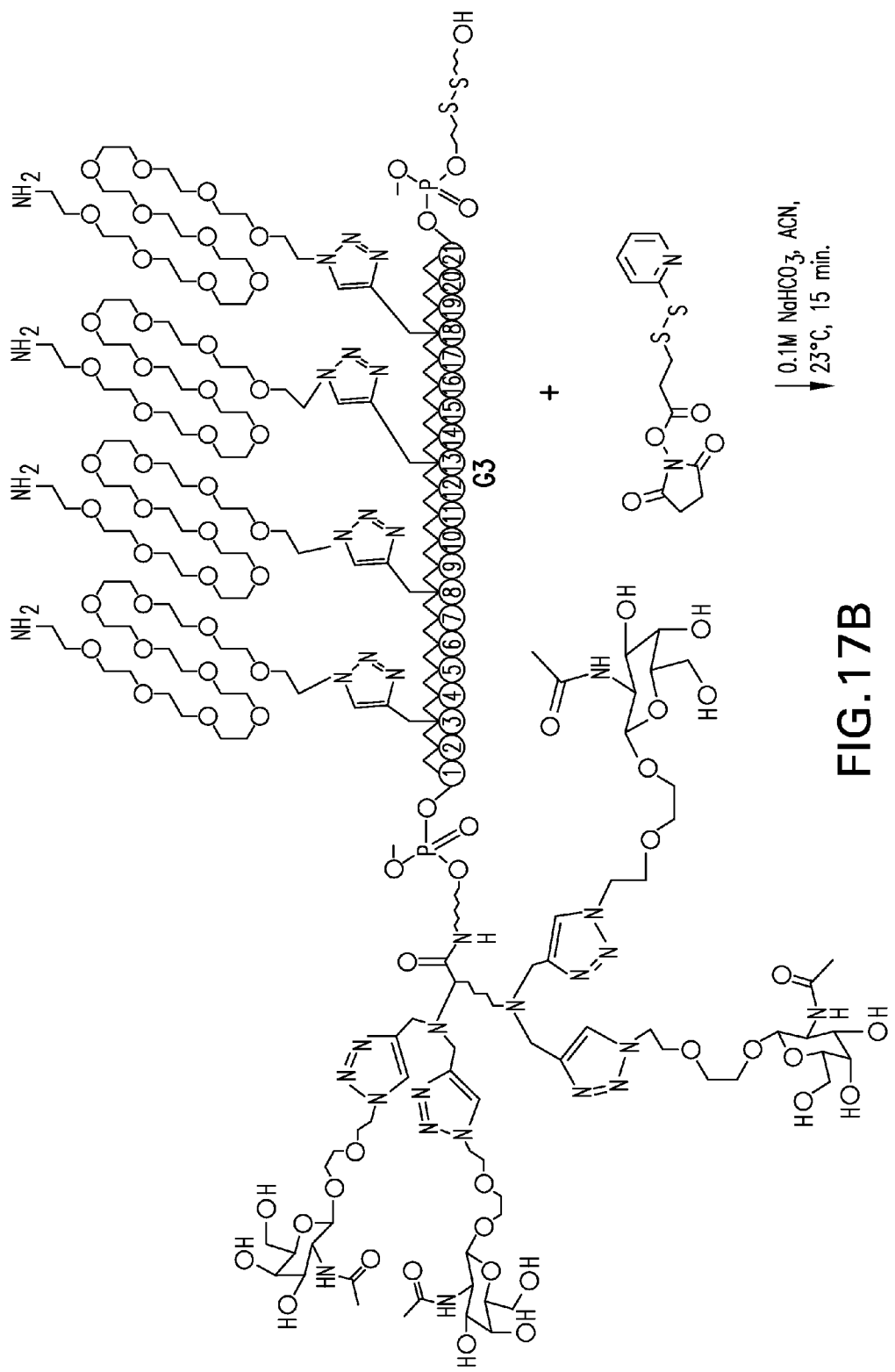
Figures 1, 17C:
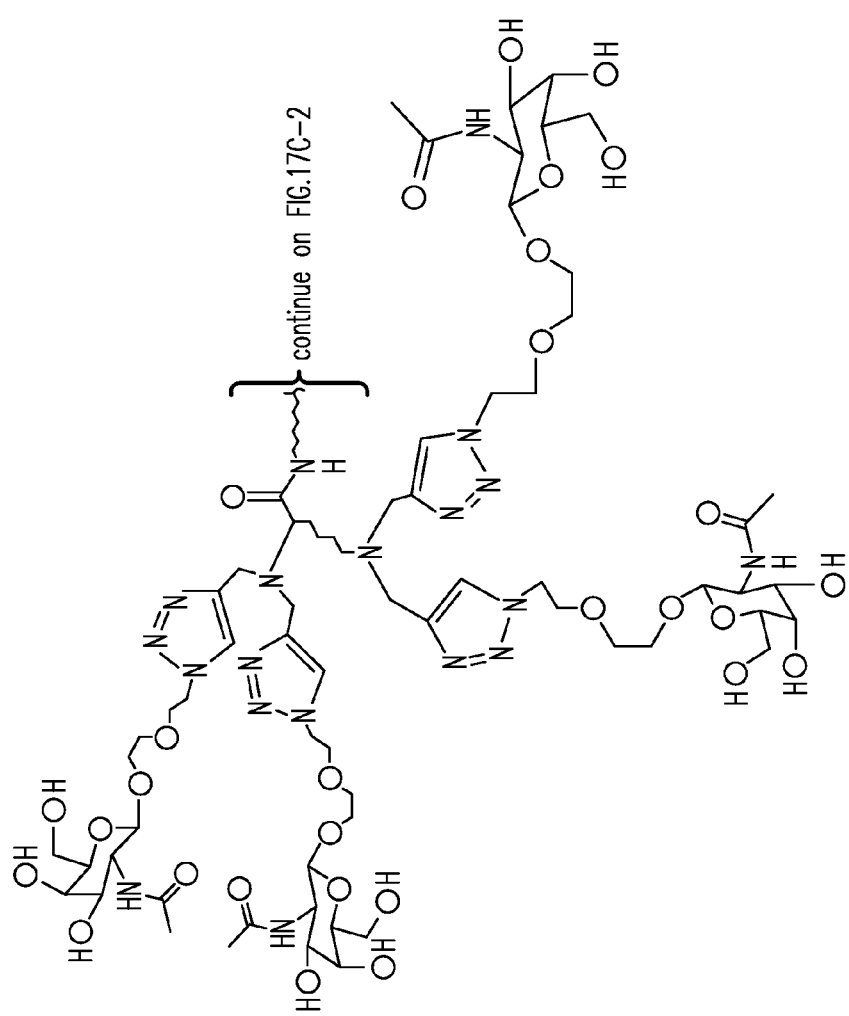
Figures 2, 17C:
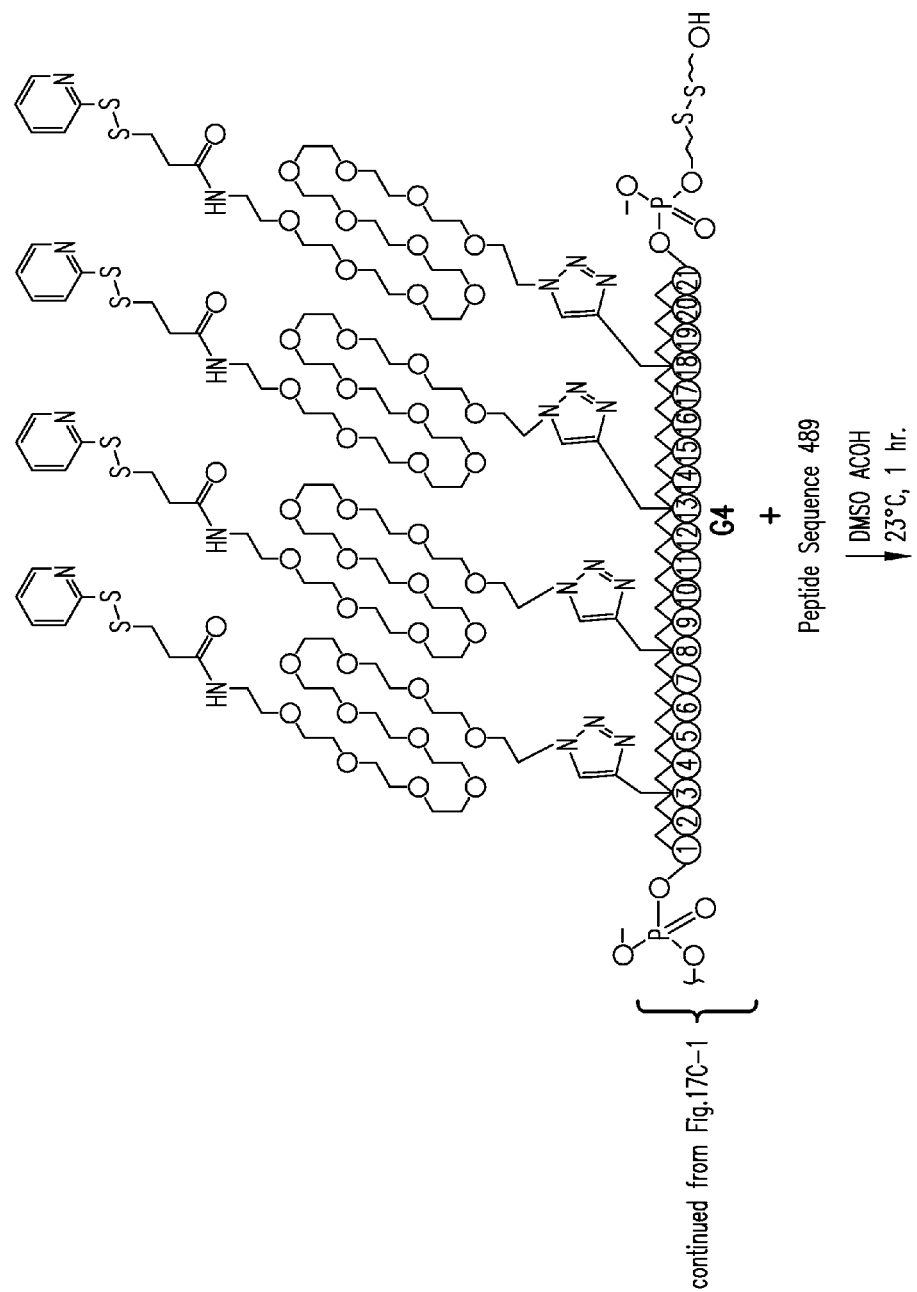
Figures 1, 17D:
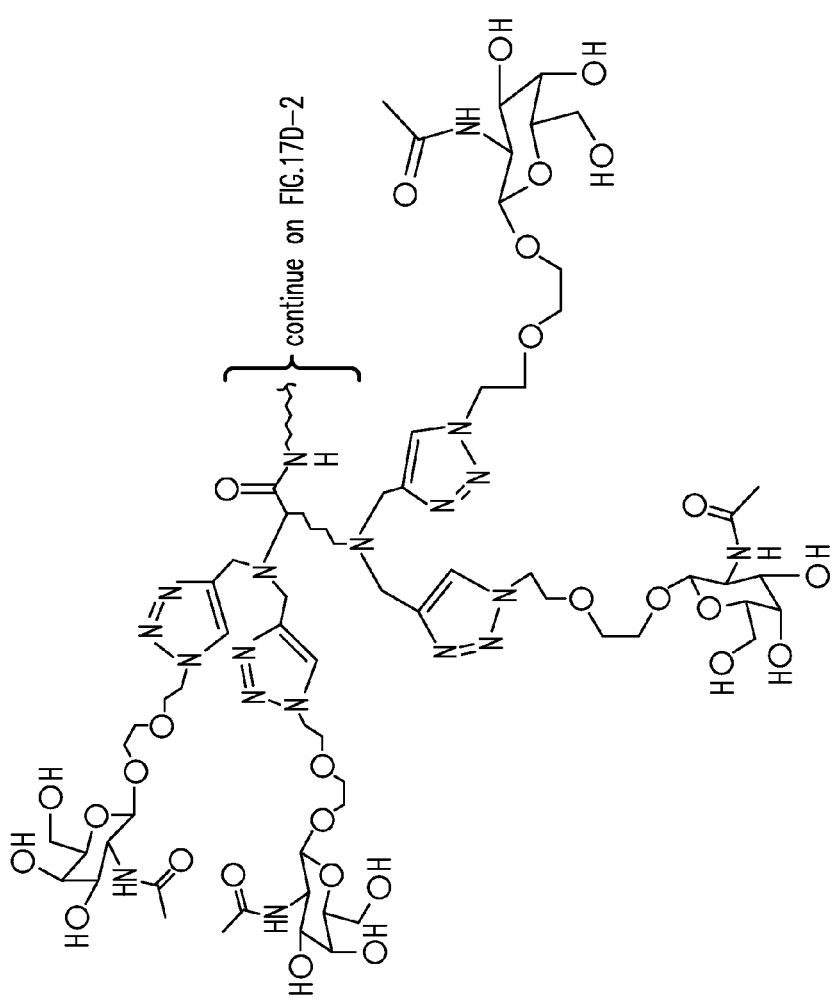
Figures 1, 18A:
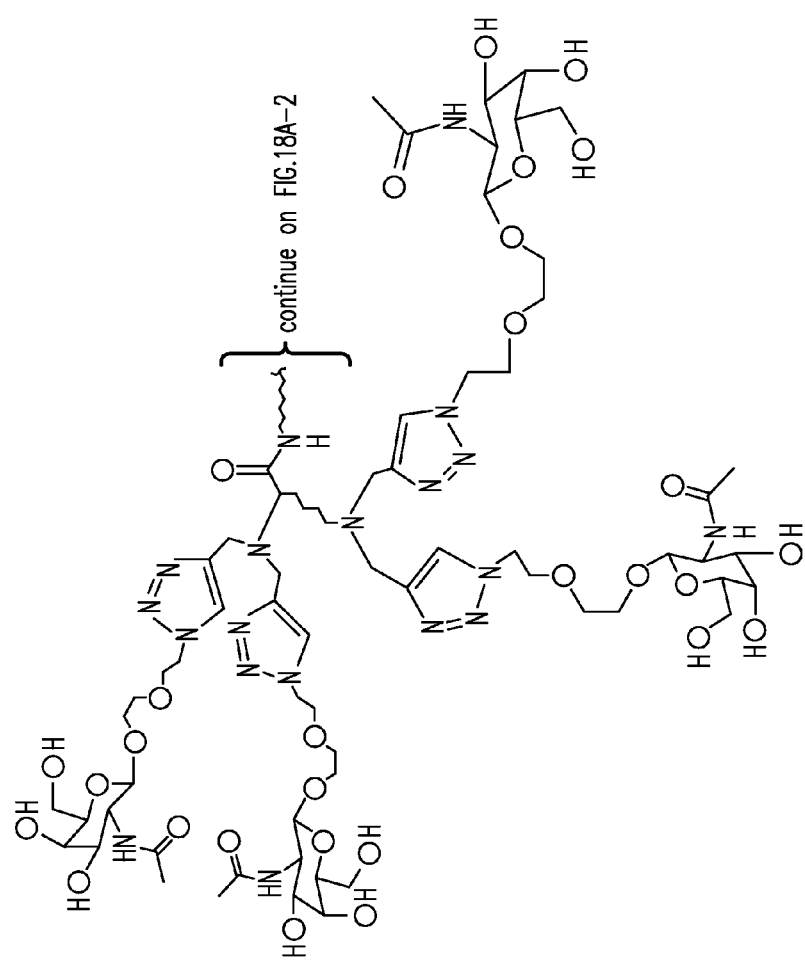
Figures 2, 18A:
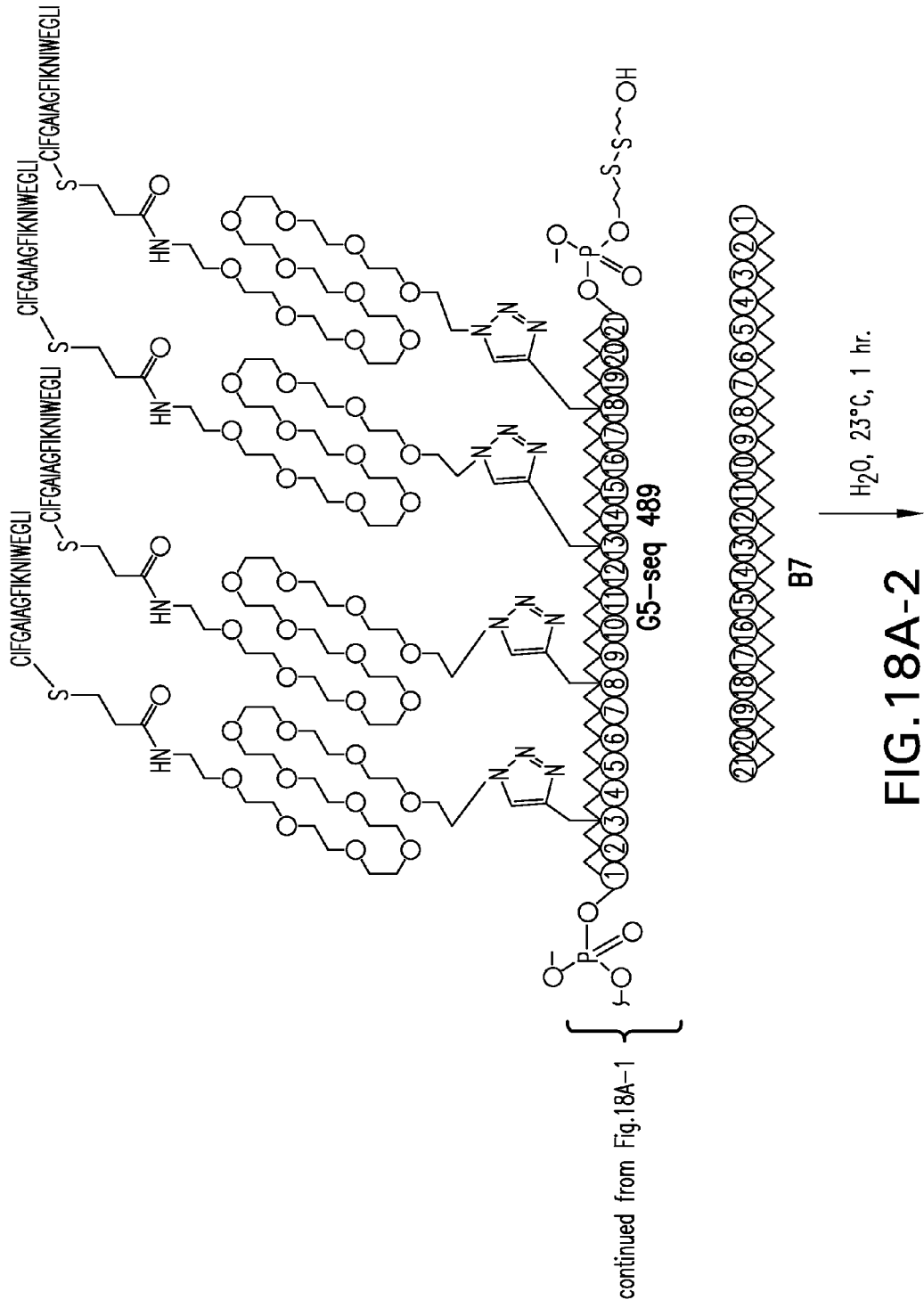
Figures 1, 18B:
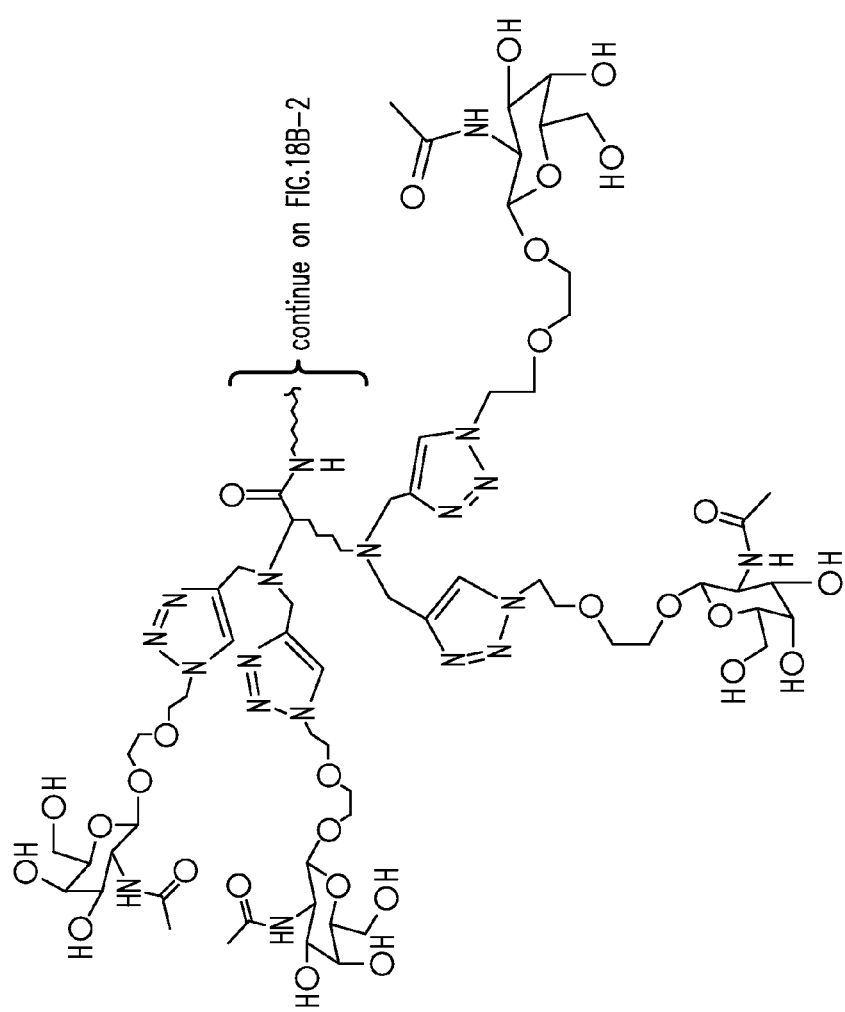
Figures 2, 18B:
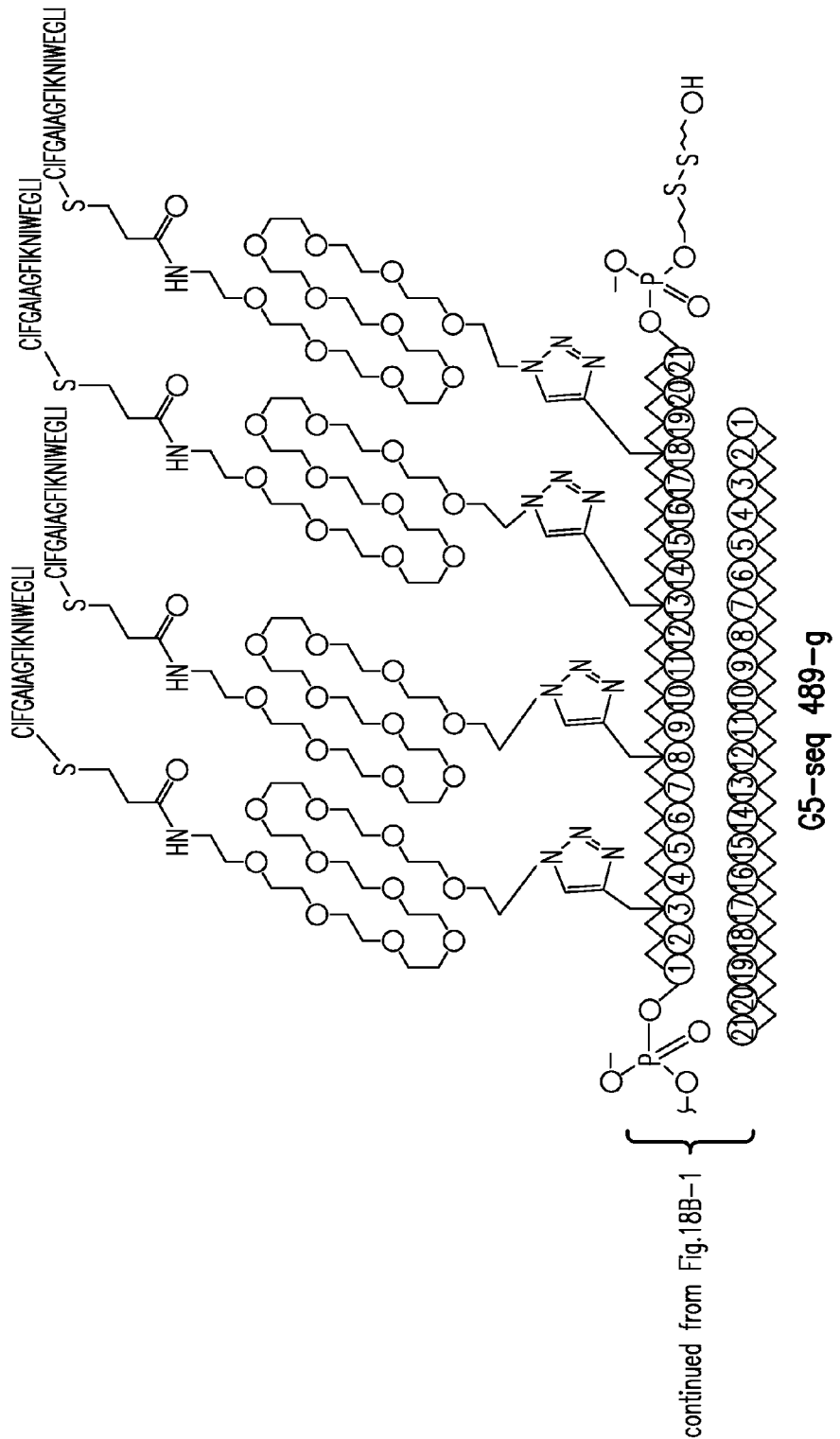
Figure 19A:
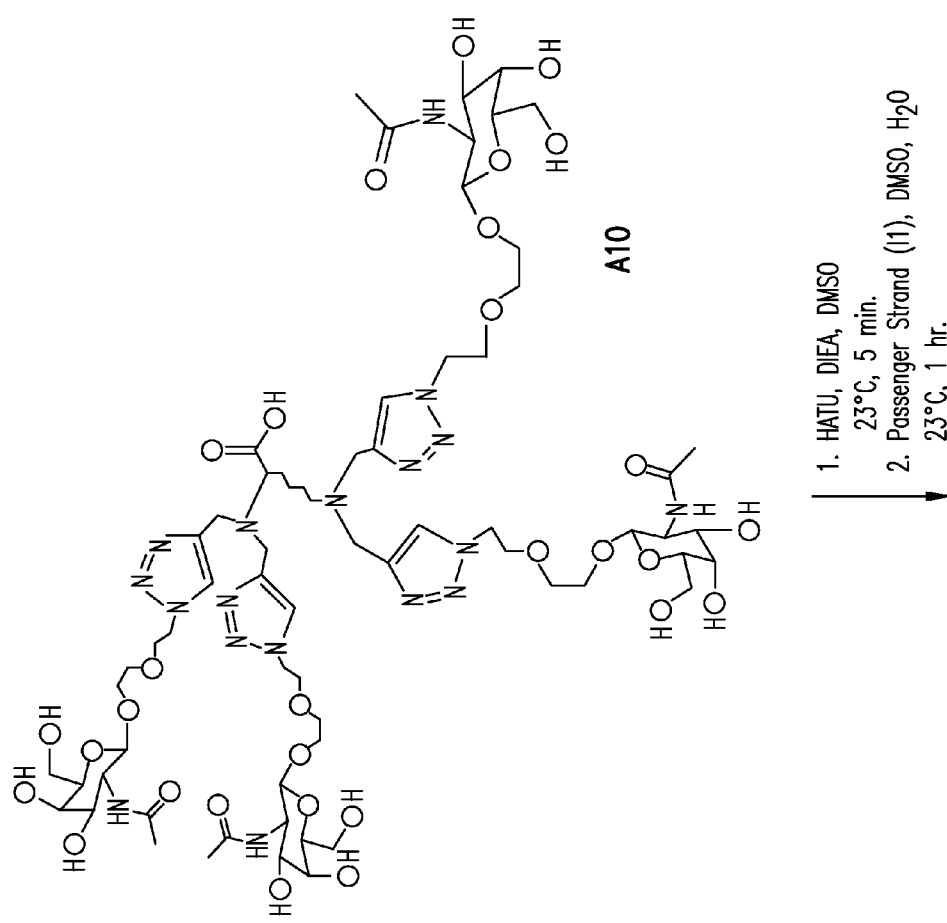
Figures 1, 19B:
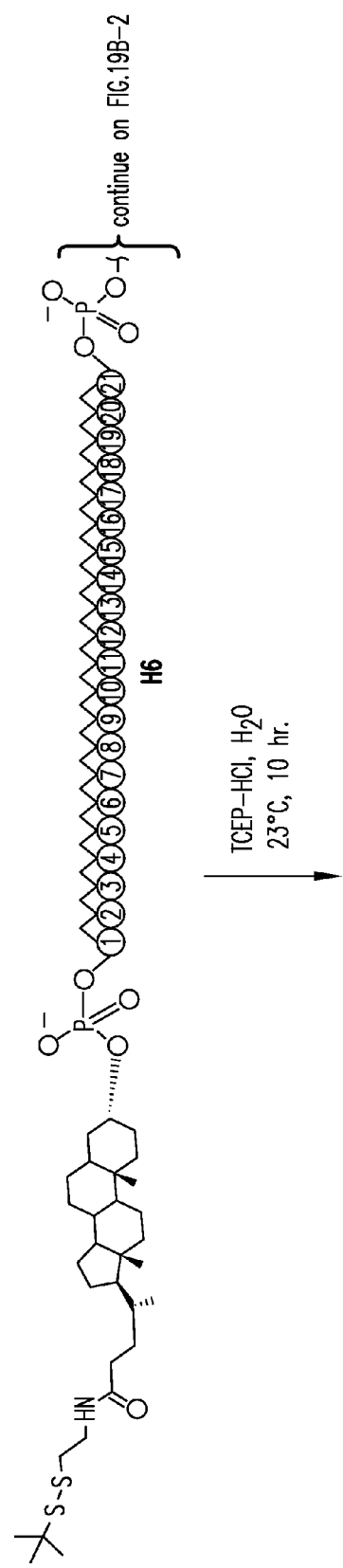
Figures 2, 19B:
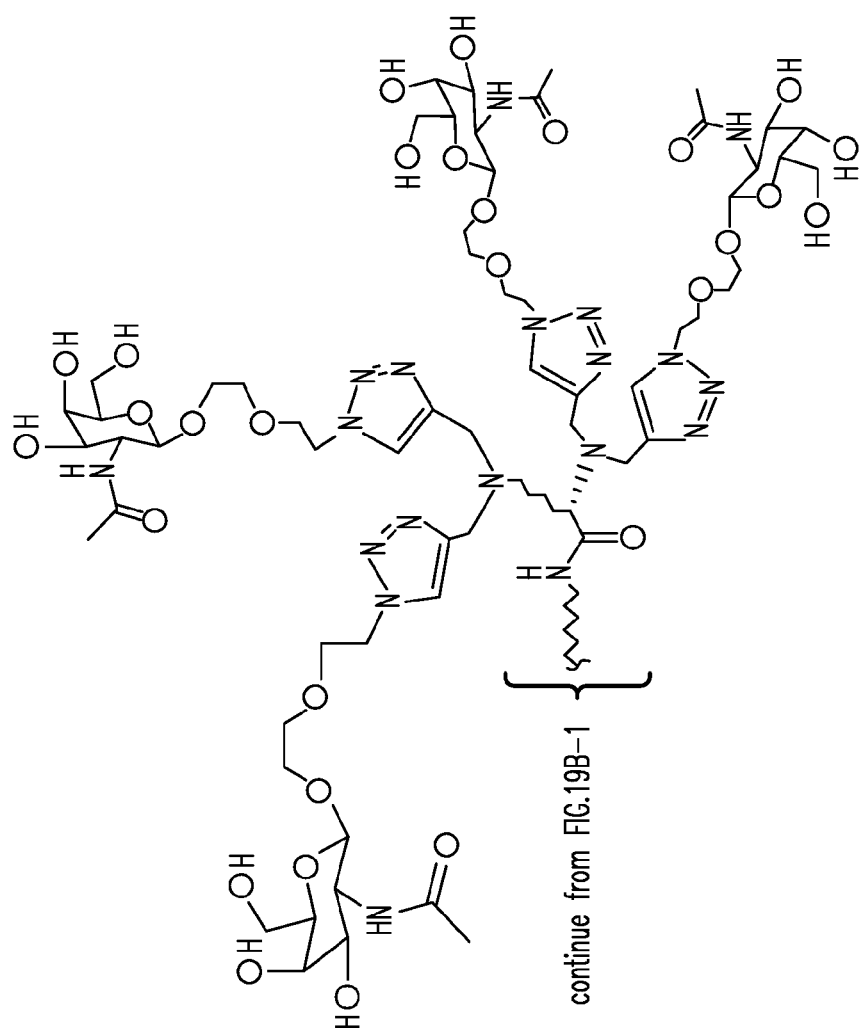
Figures 1, 19C:
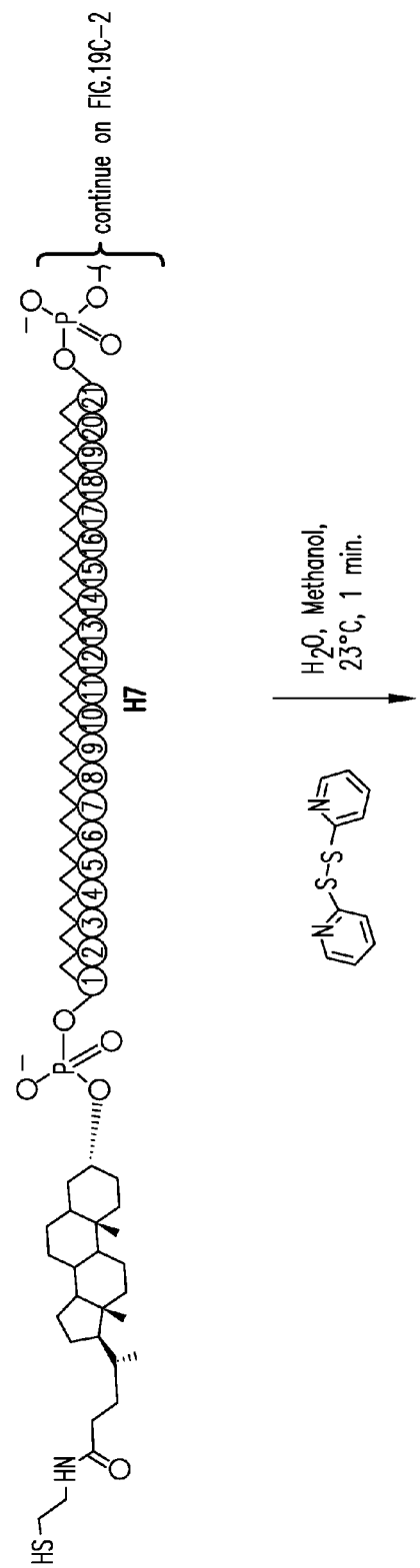
Figures 2, 19C:
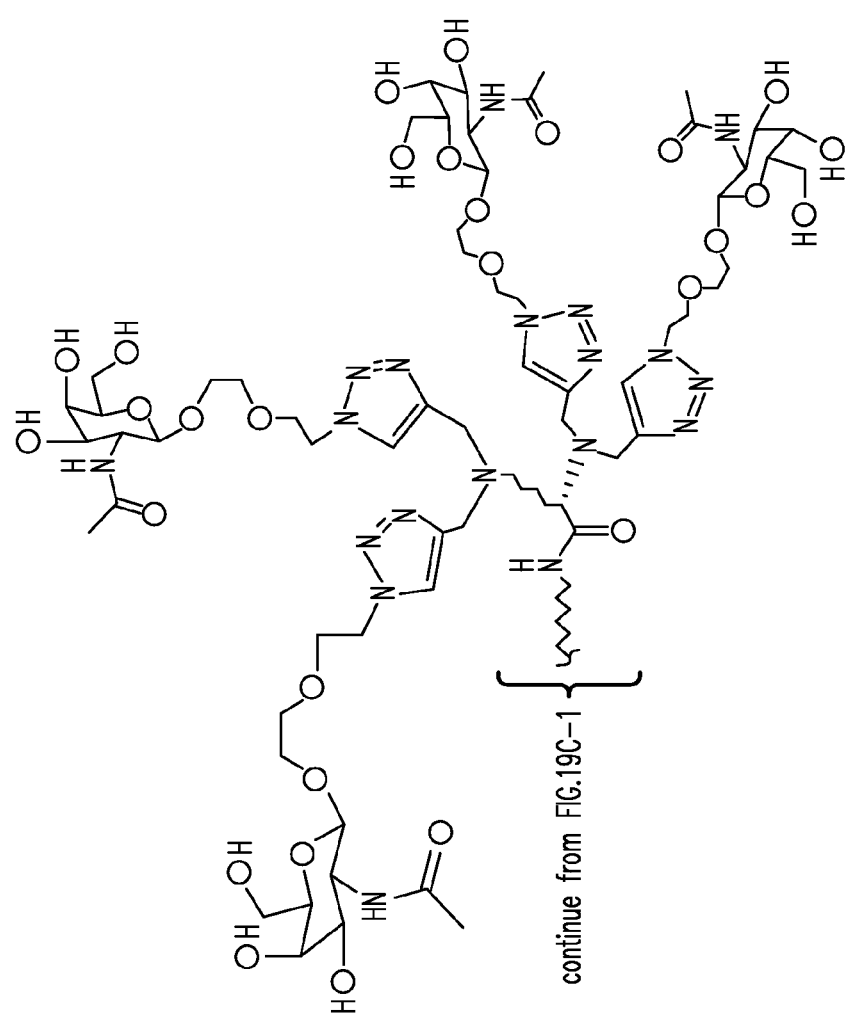
Figures 1, 19D:
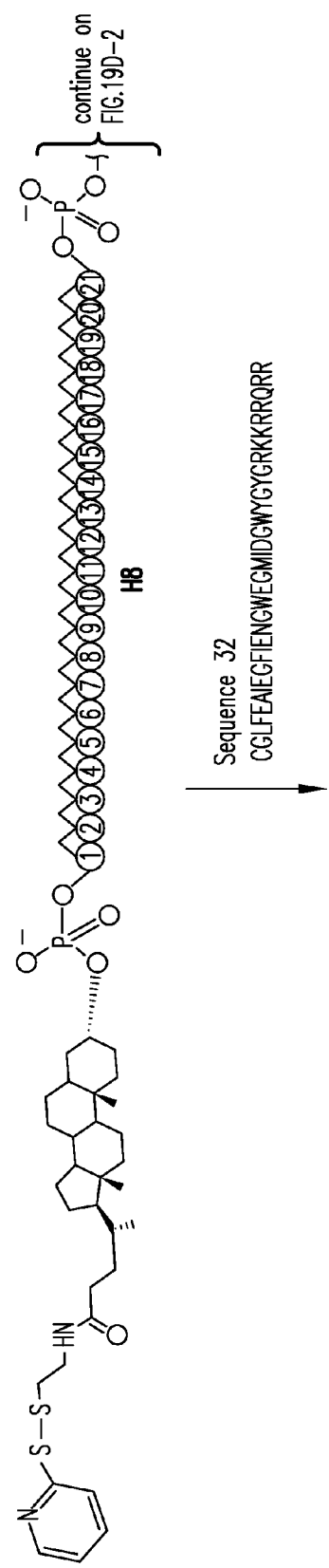
Figures 2, 19D:
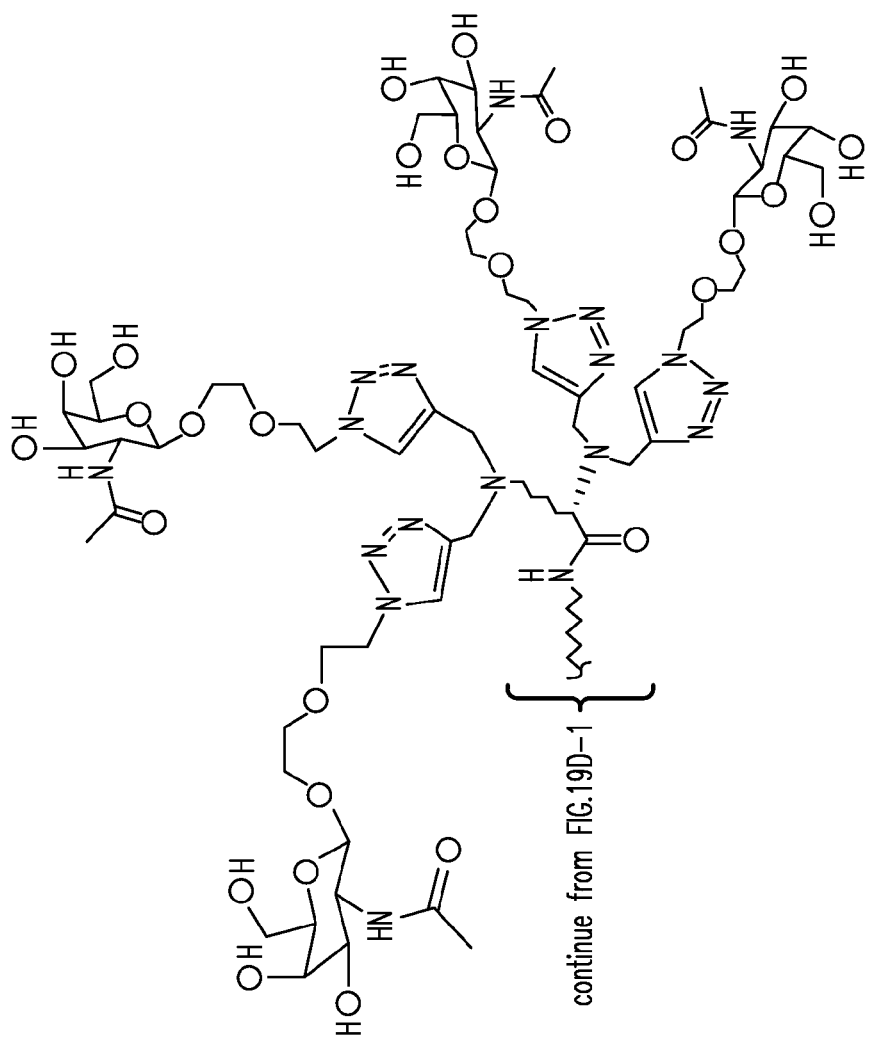
Figures 1, 19E:
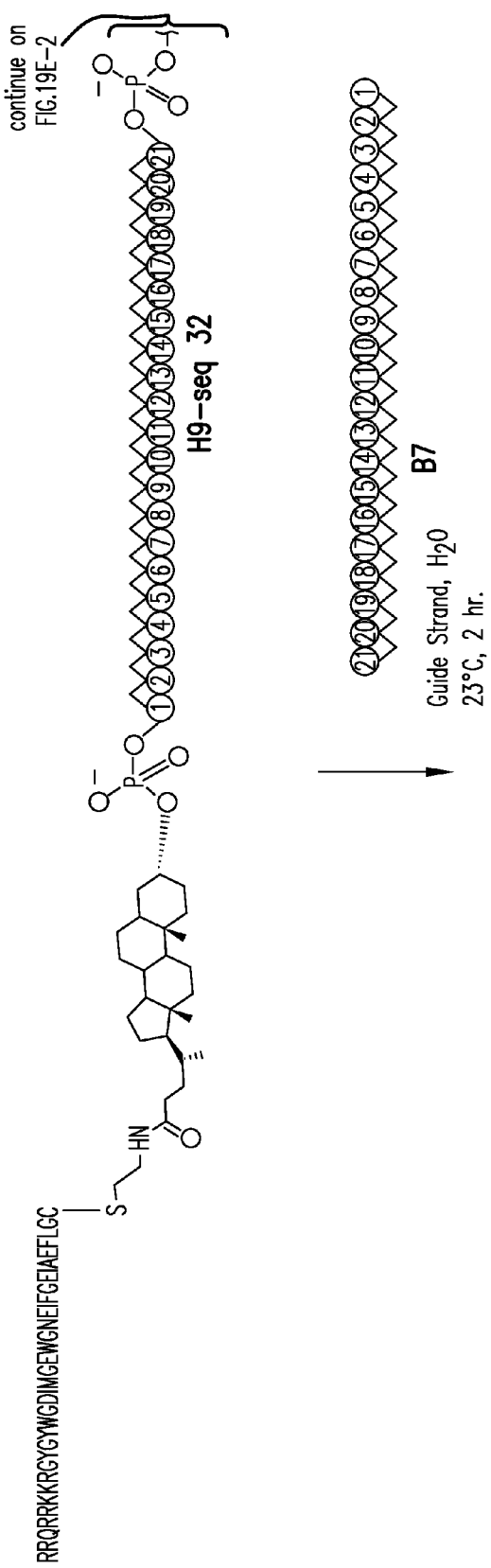
Figures 2, 19E:
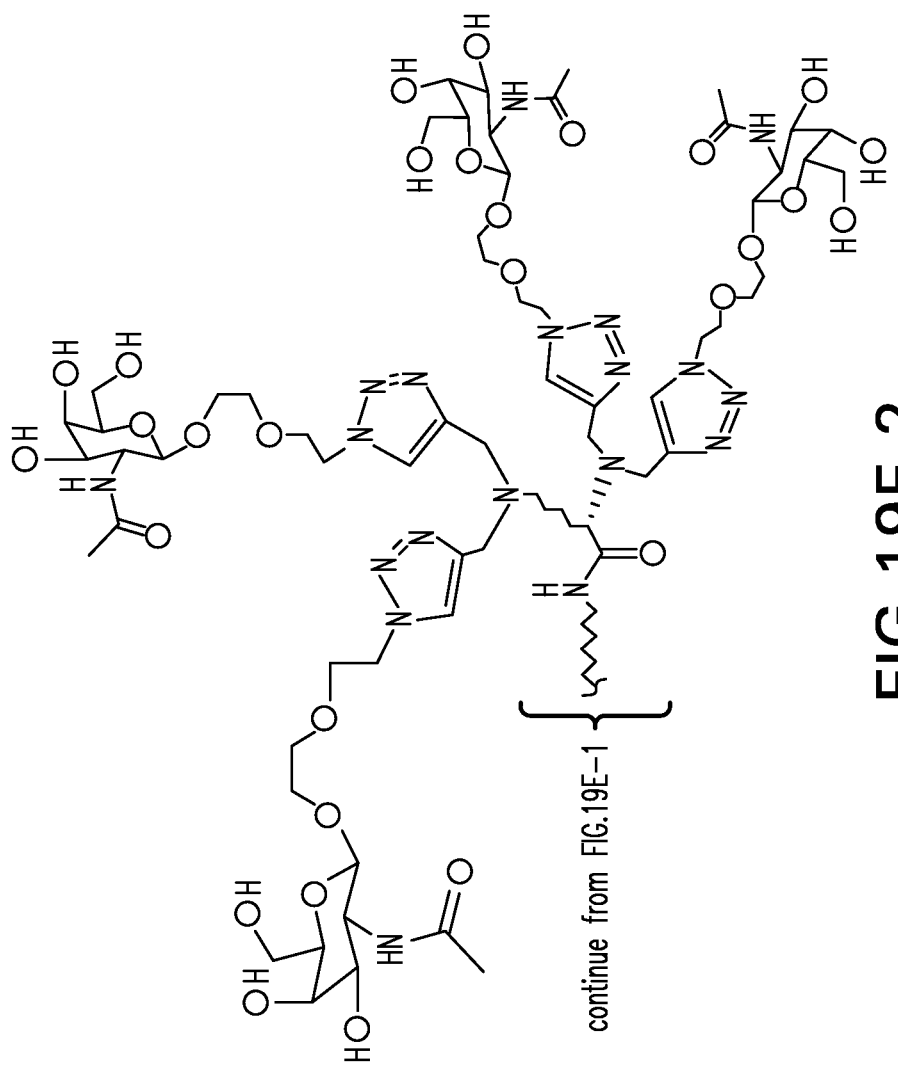
Figures 1, 19F:
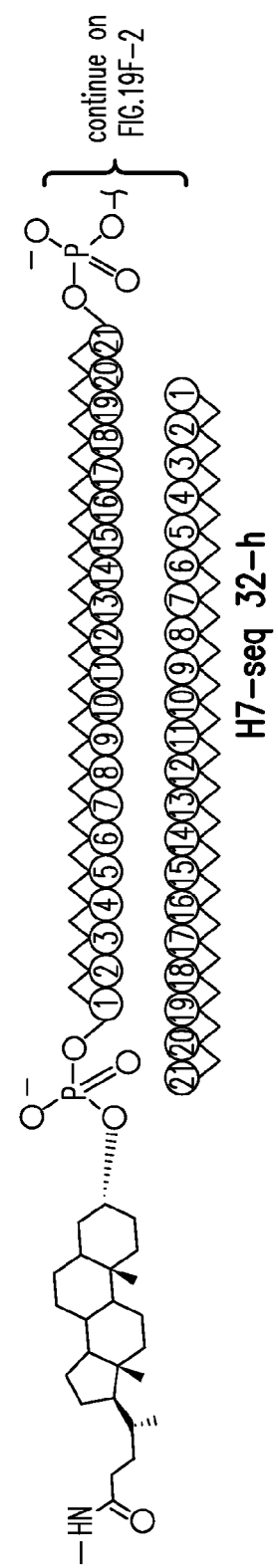
Figures 2, 19F:
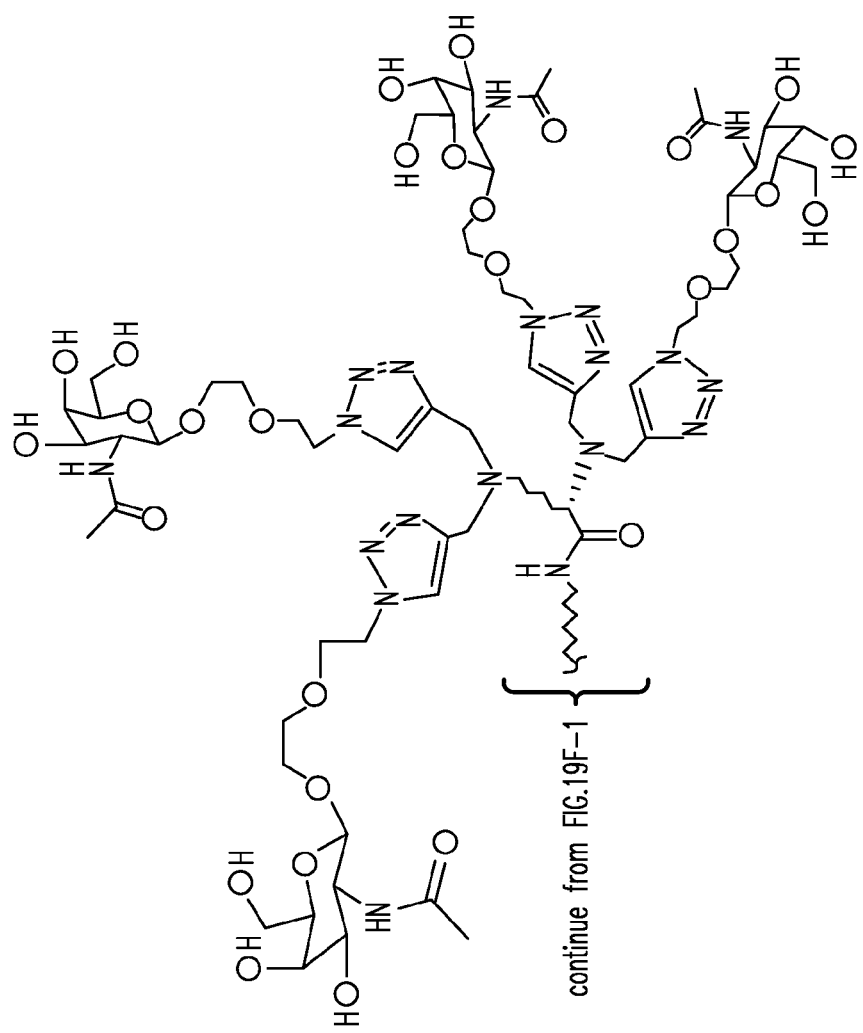
Figures 1, 19G:
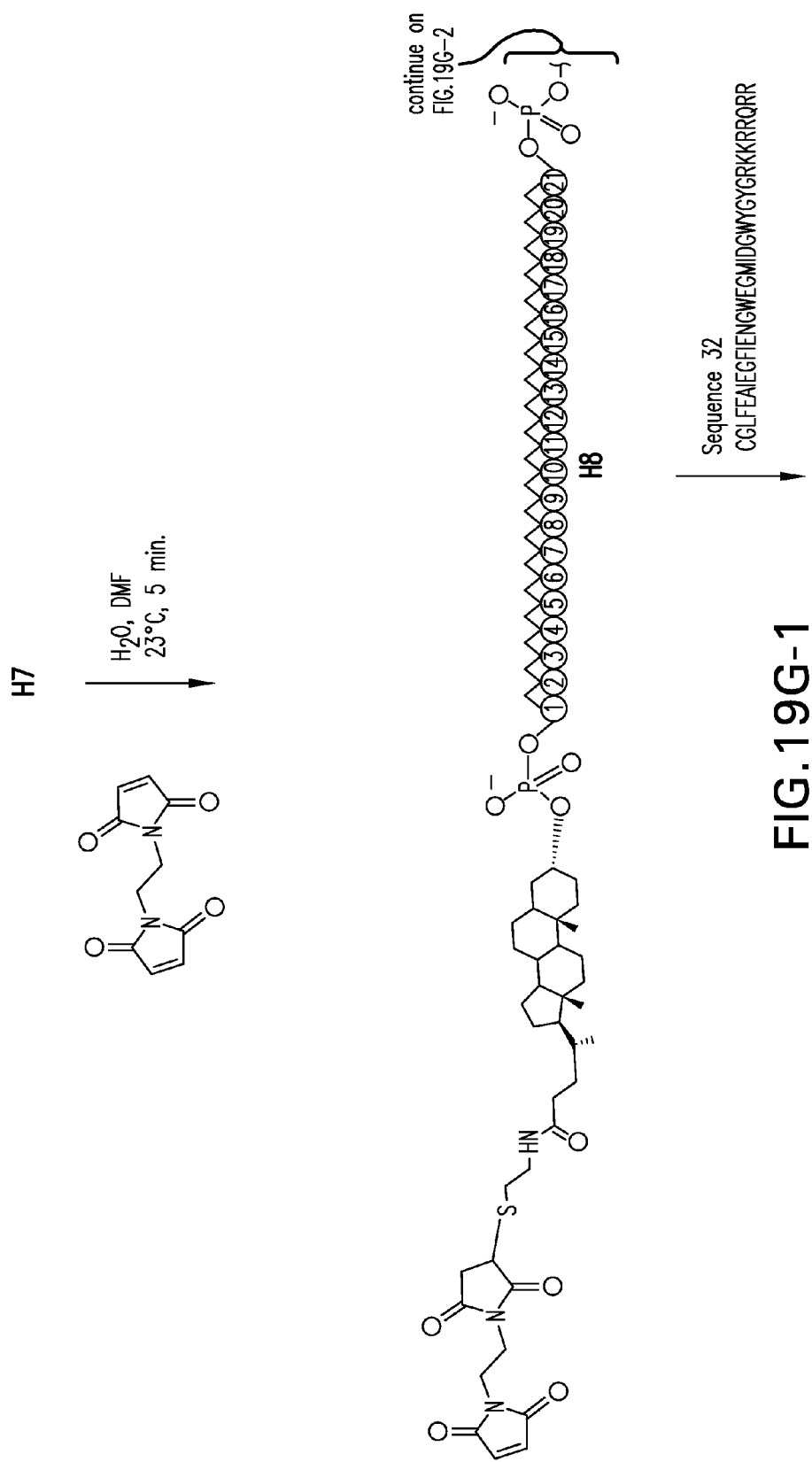
Figures 2, 19G:
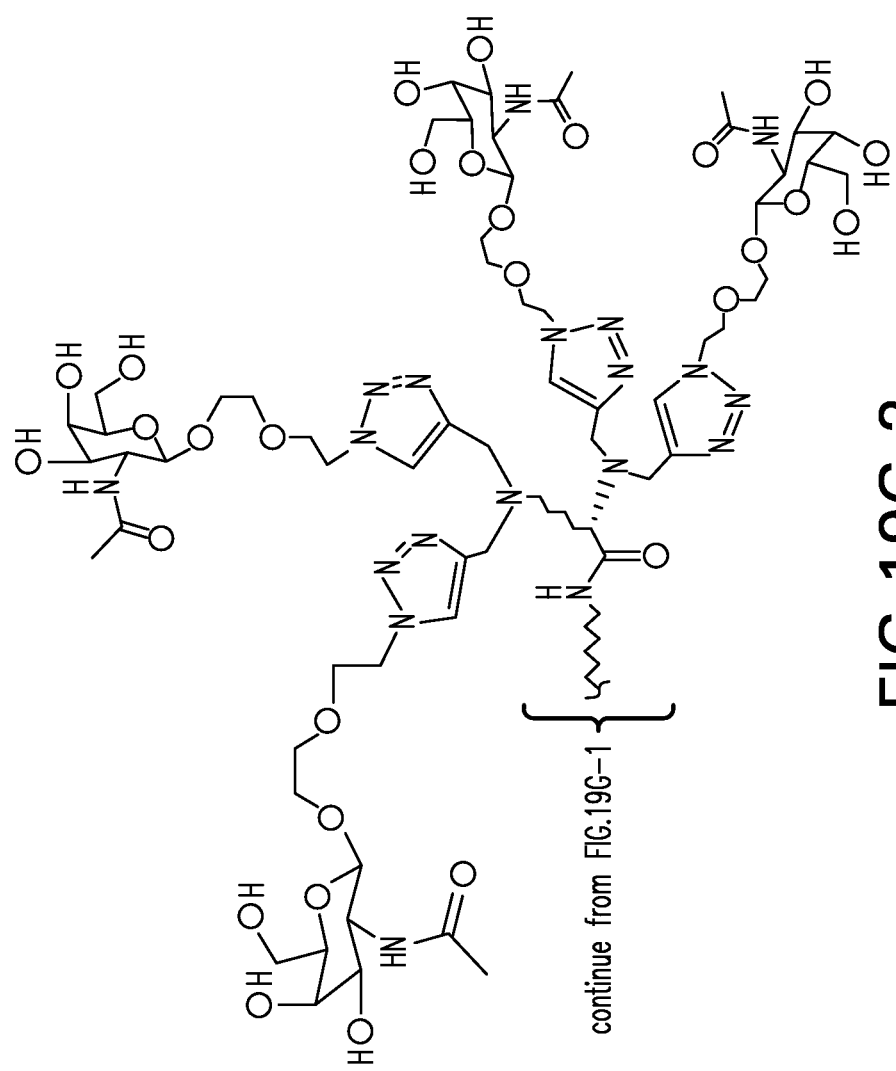
Figures 2, 19H:
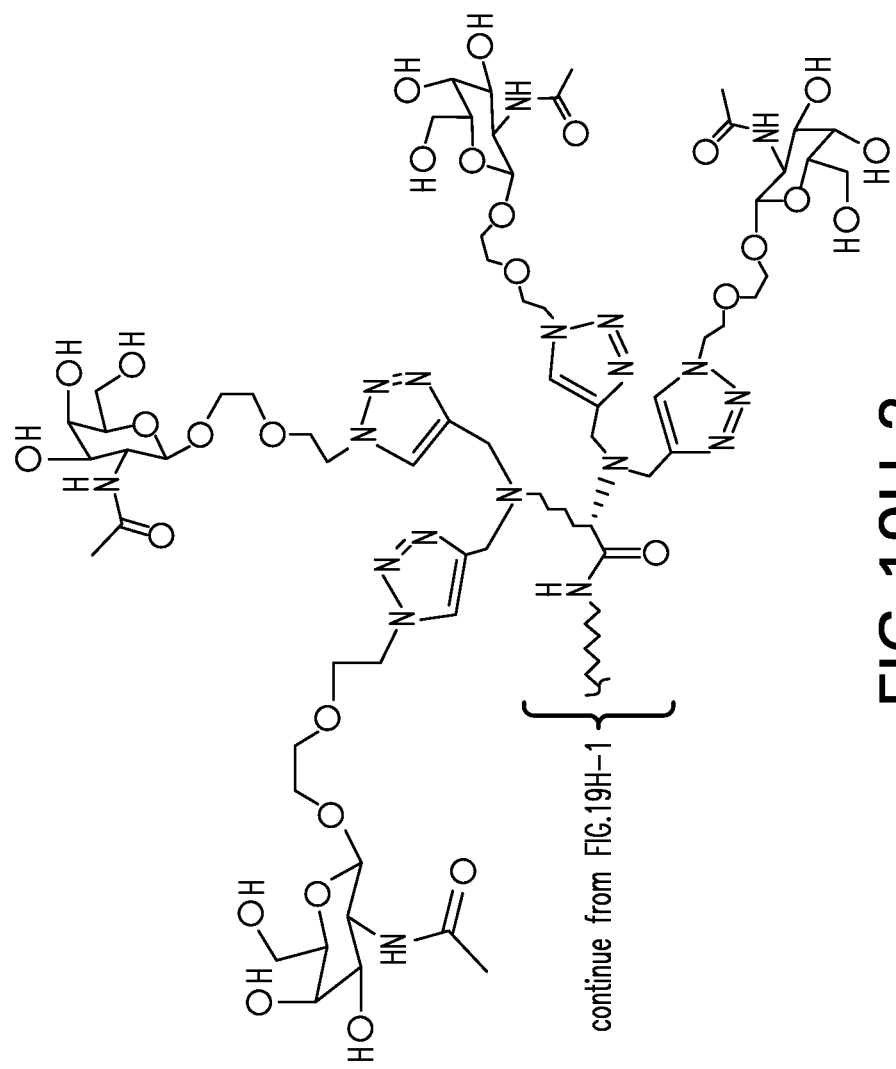
Figures 1, 19I:
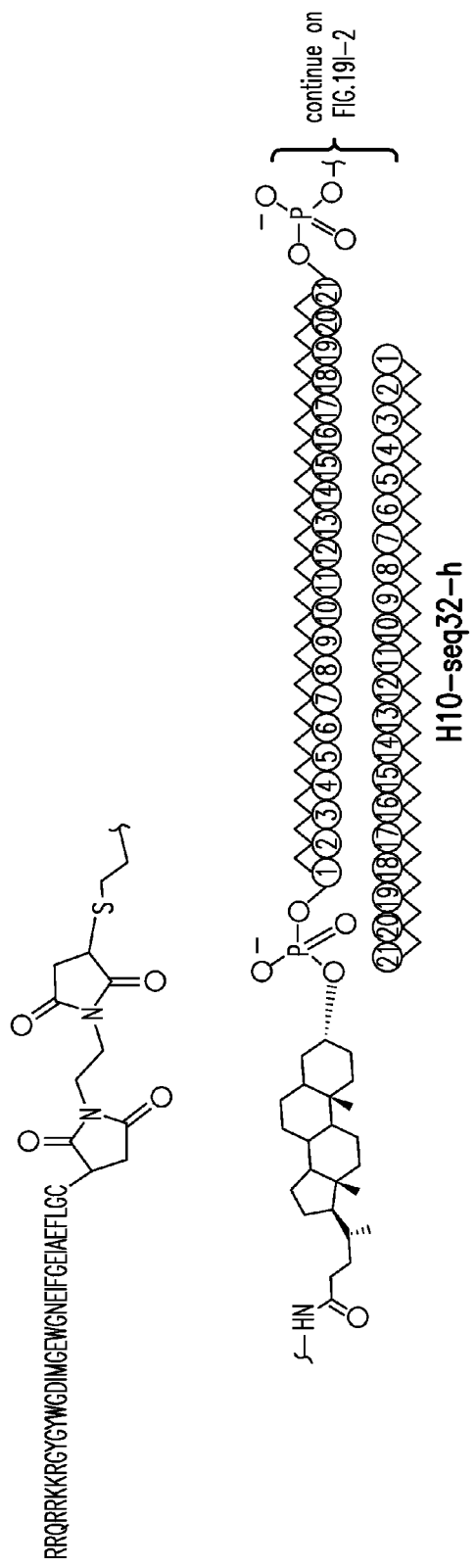
Figures 2, 19I:
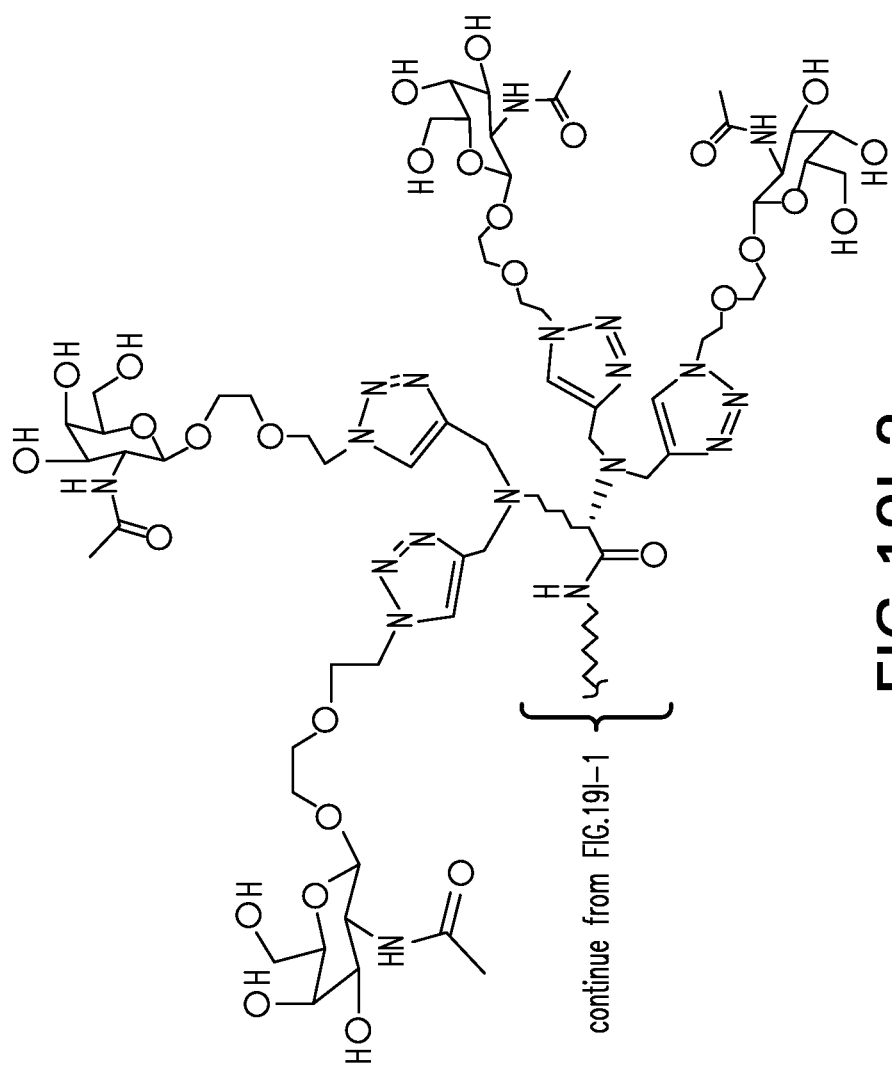
Figures 1, 20A:
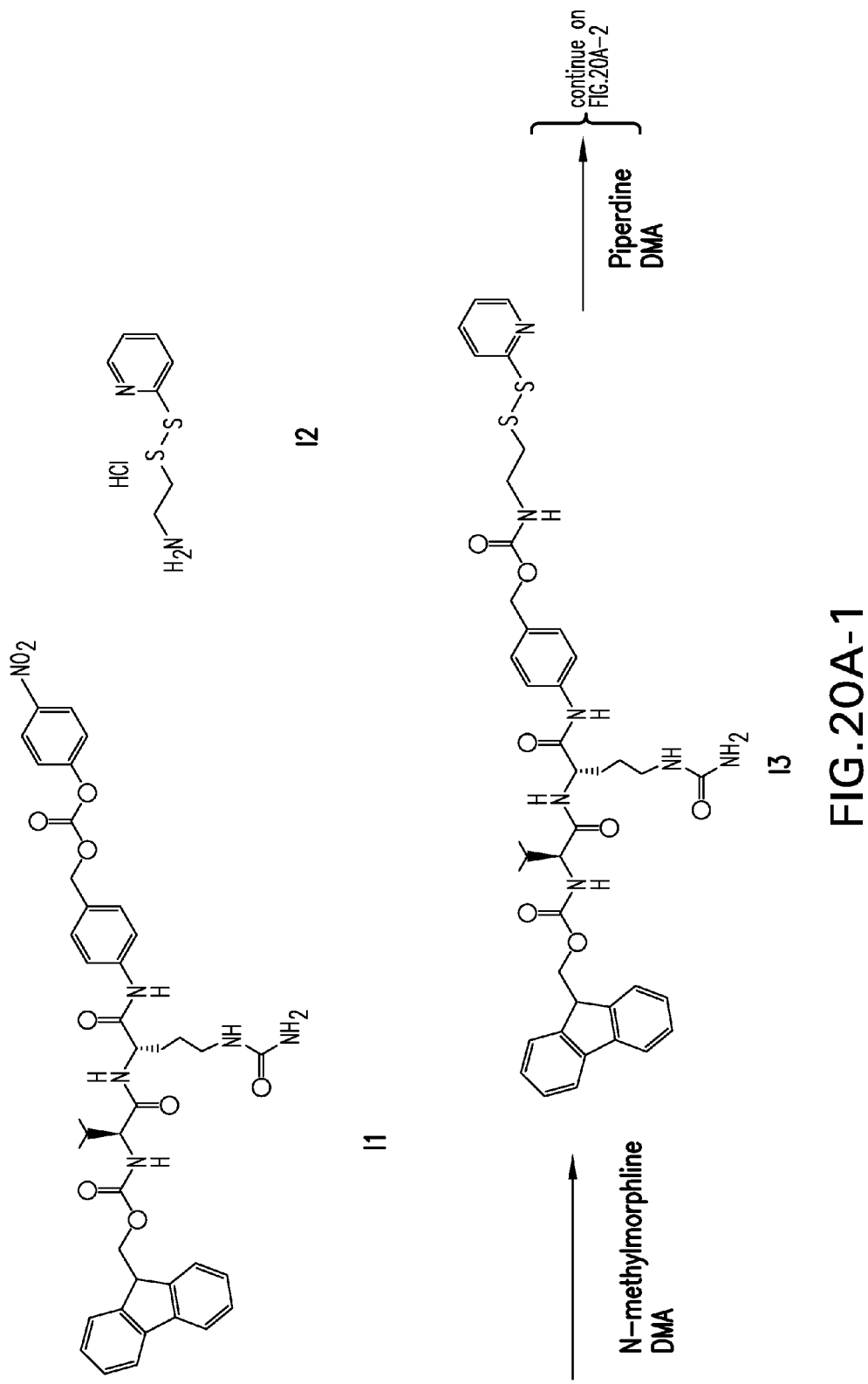
Figures 2, 20A:
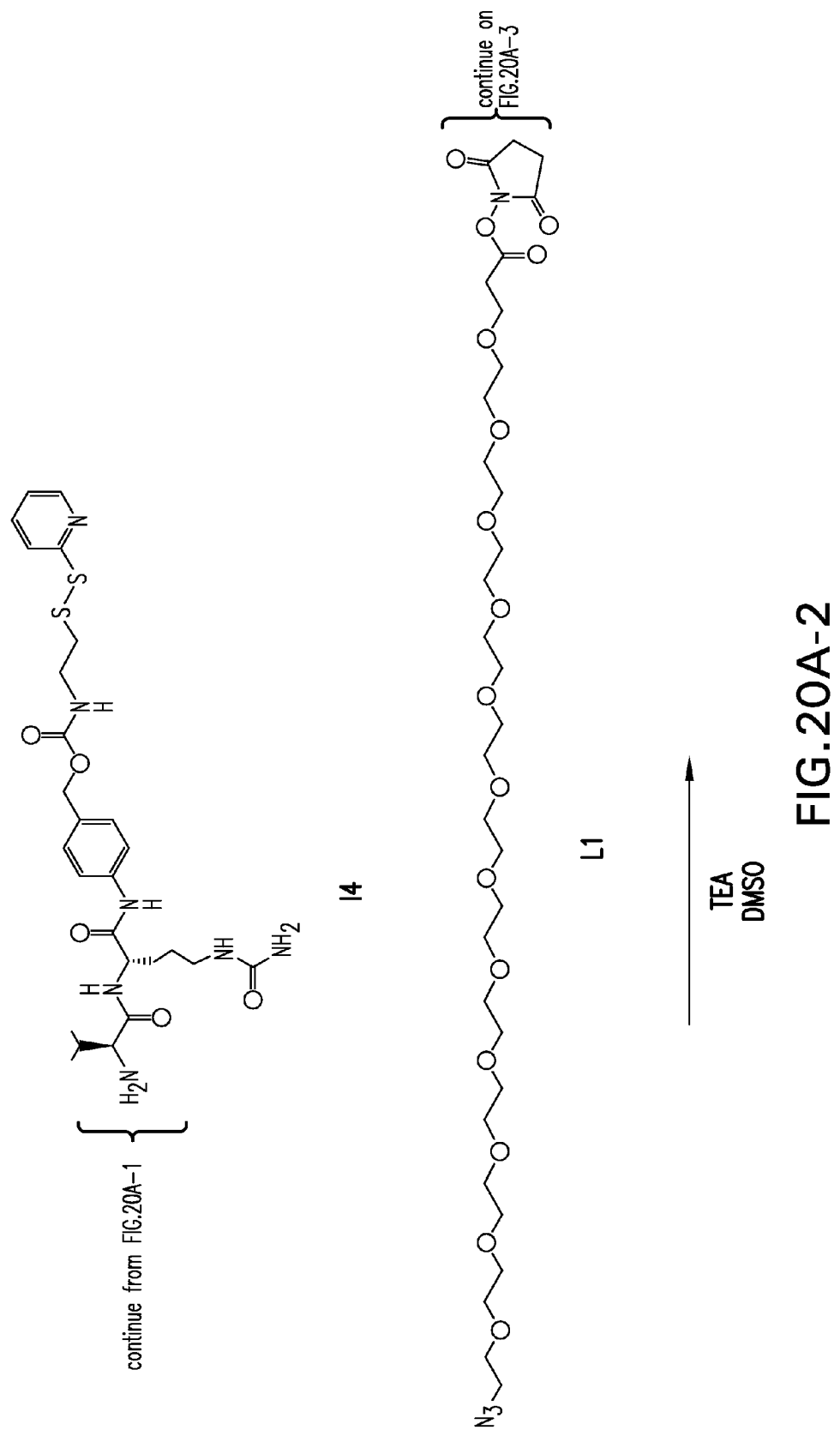
Figures 3, 20A:
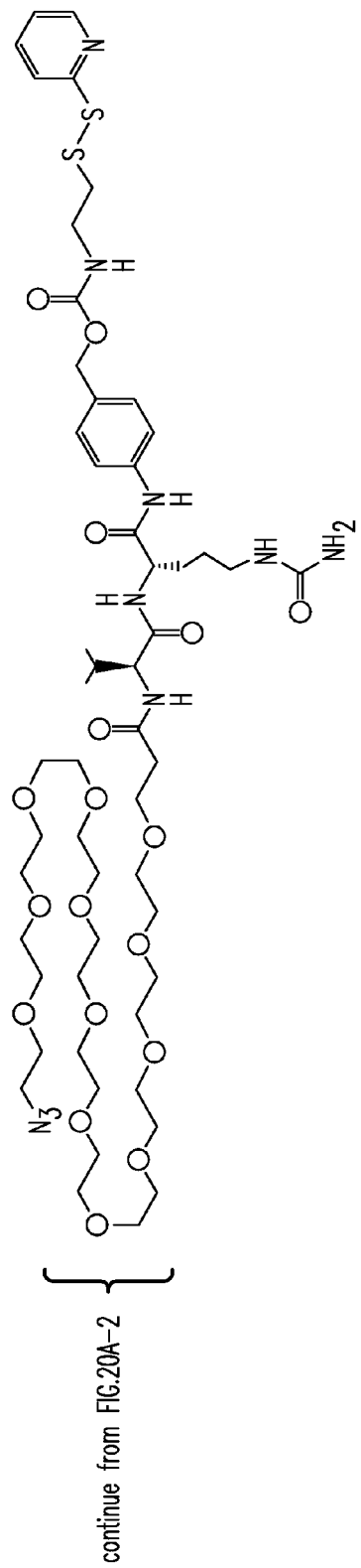
Figures 1, 20B:
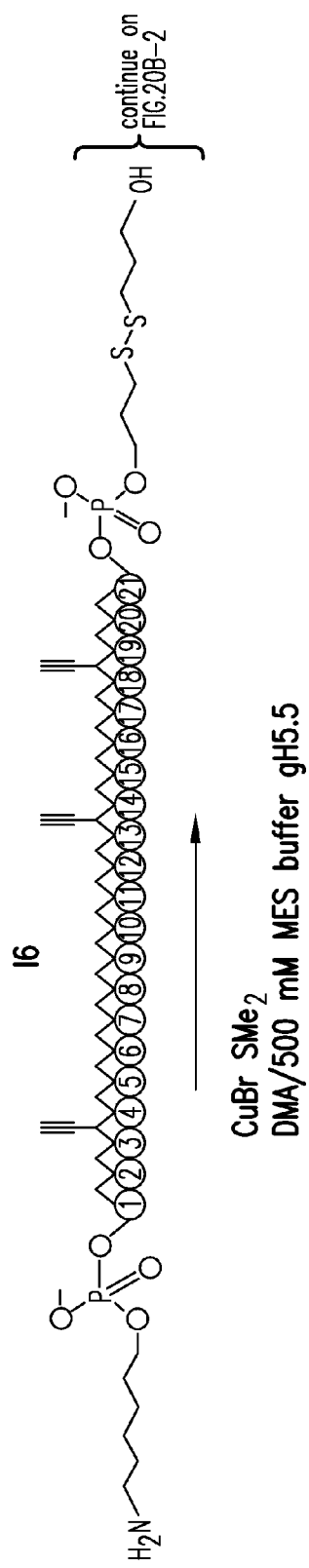
Figures 2, 20B:
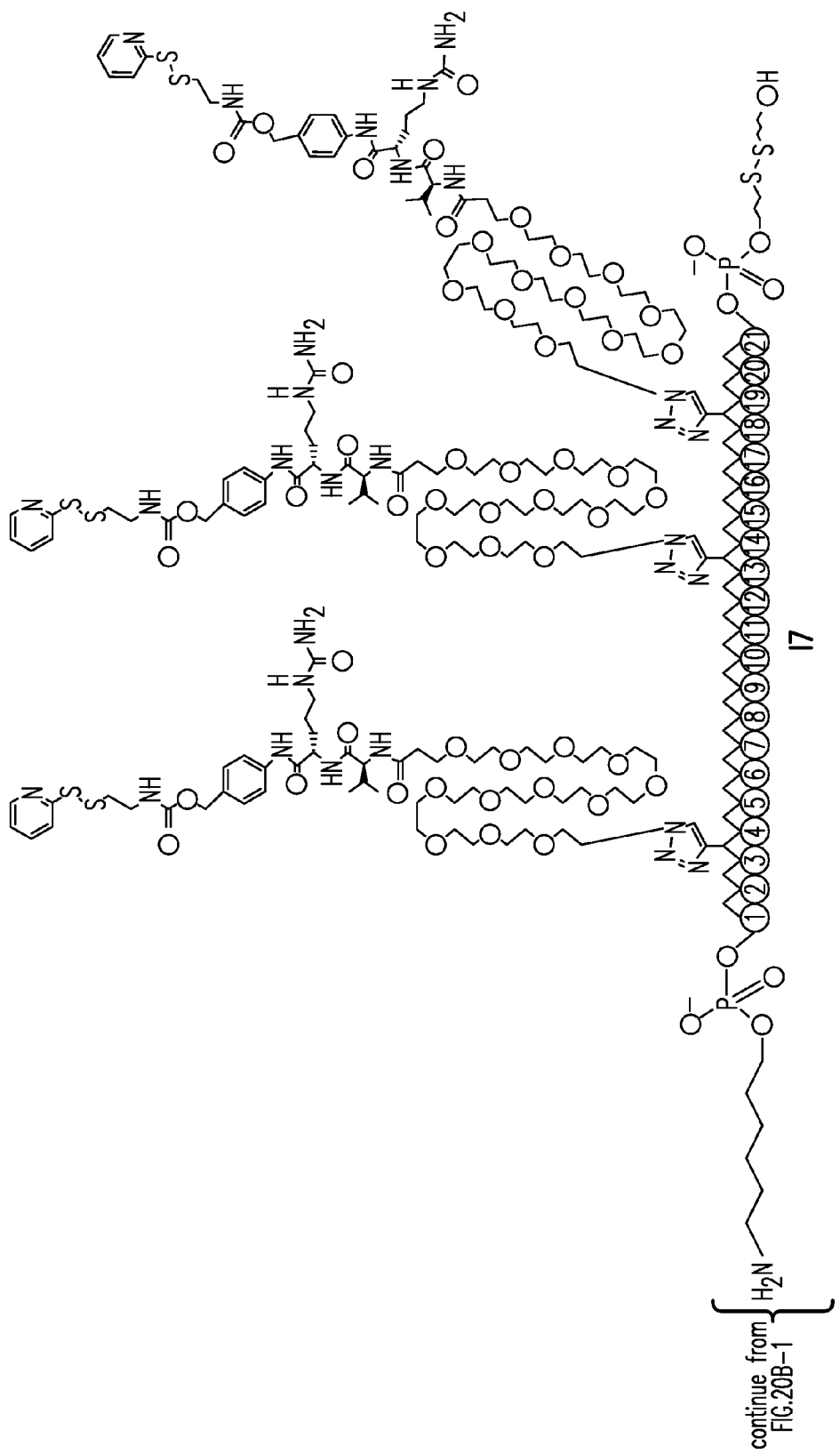
Figures 1, 20C:
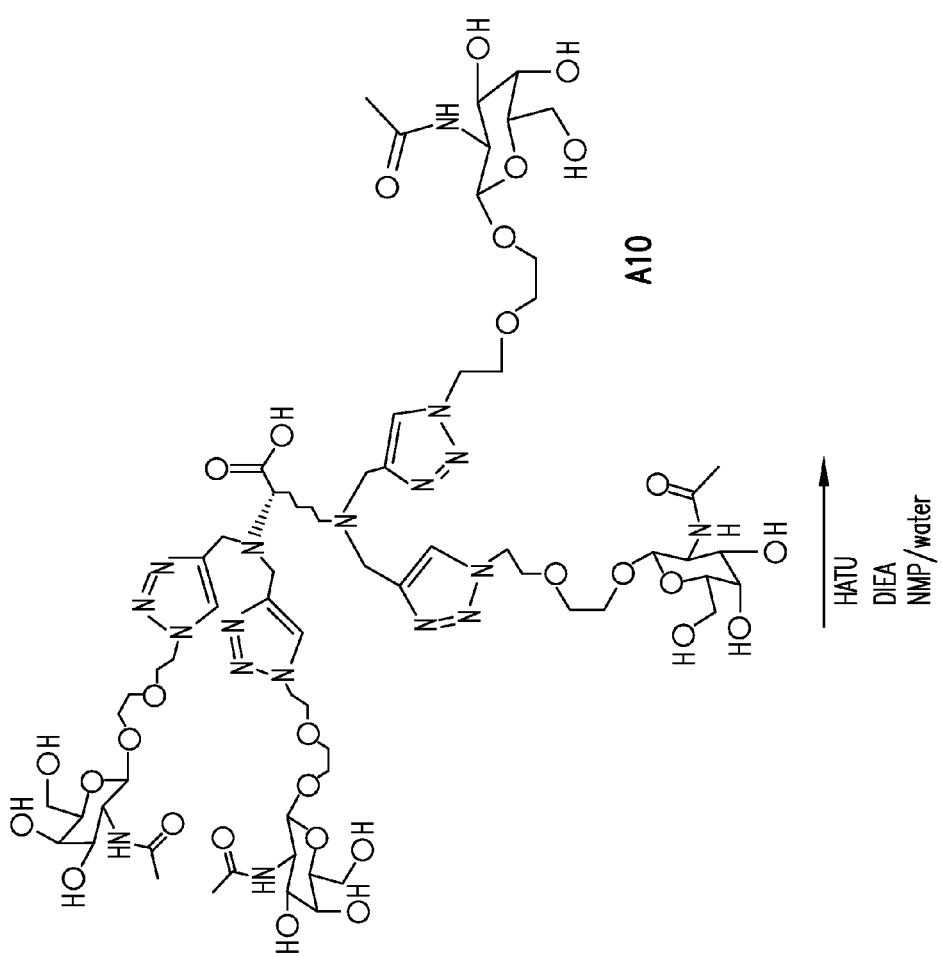
Figures 2, 20C:
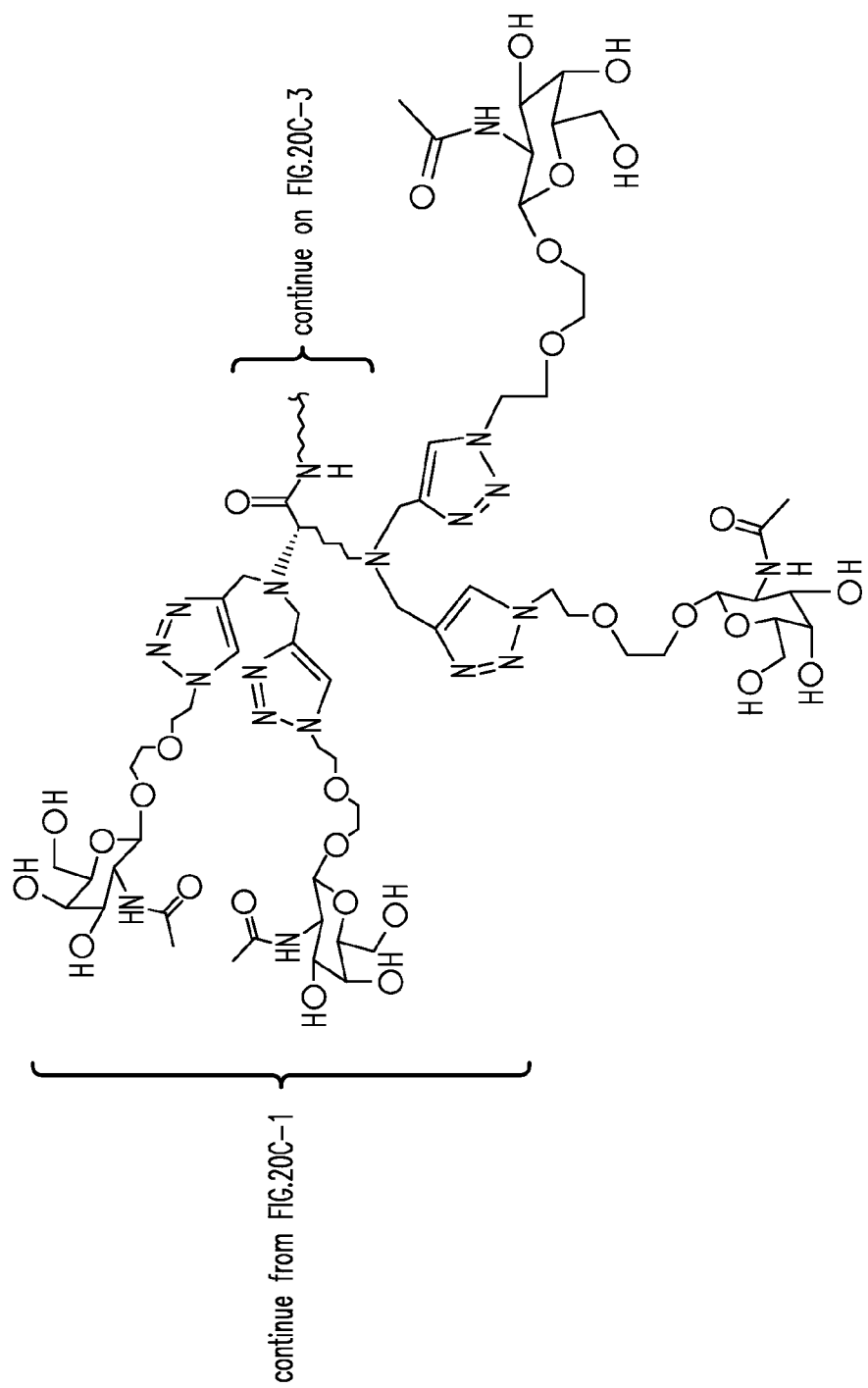
Figures 3, 20C:
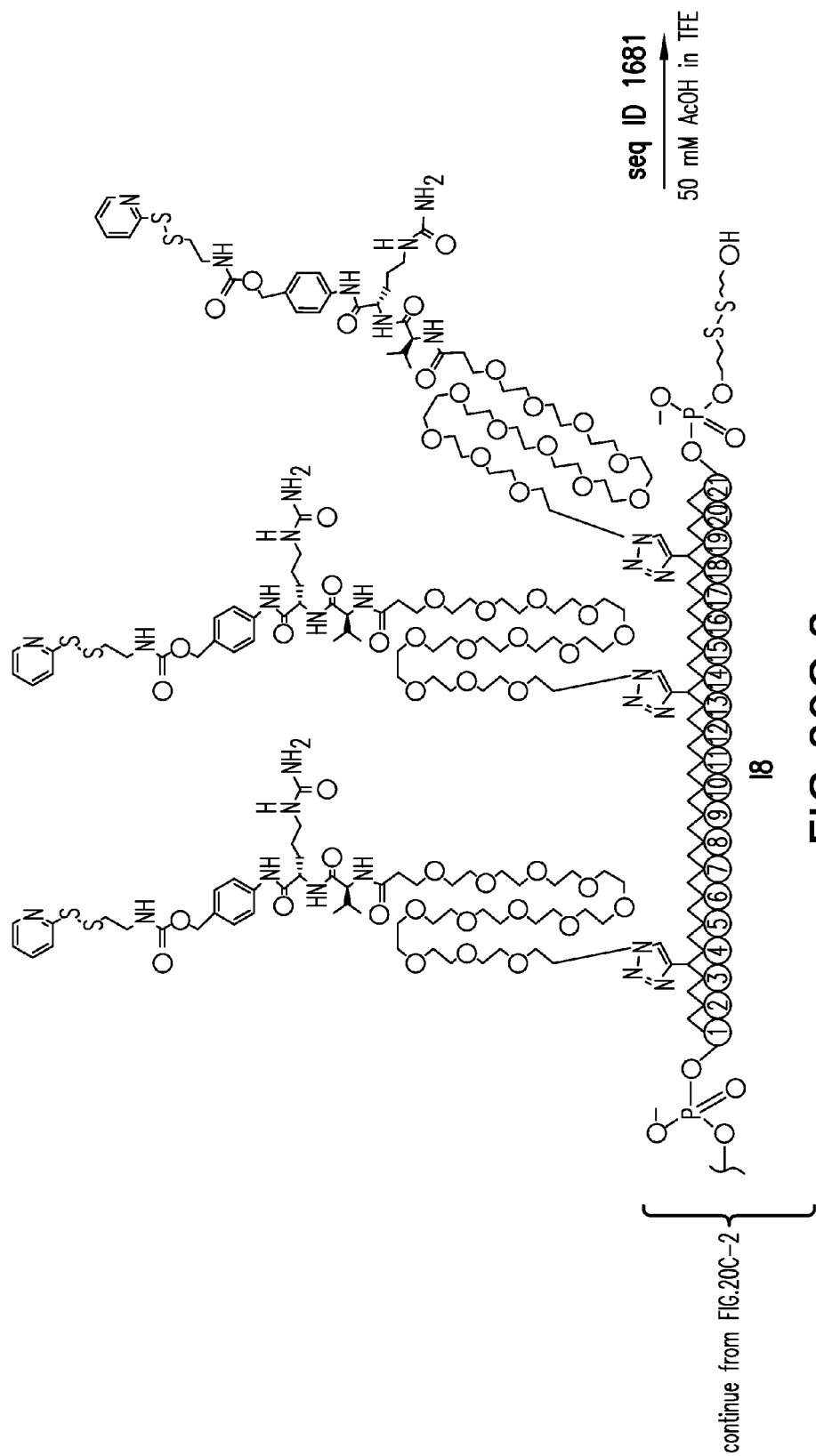
Figures 1, 20D:
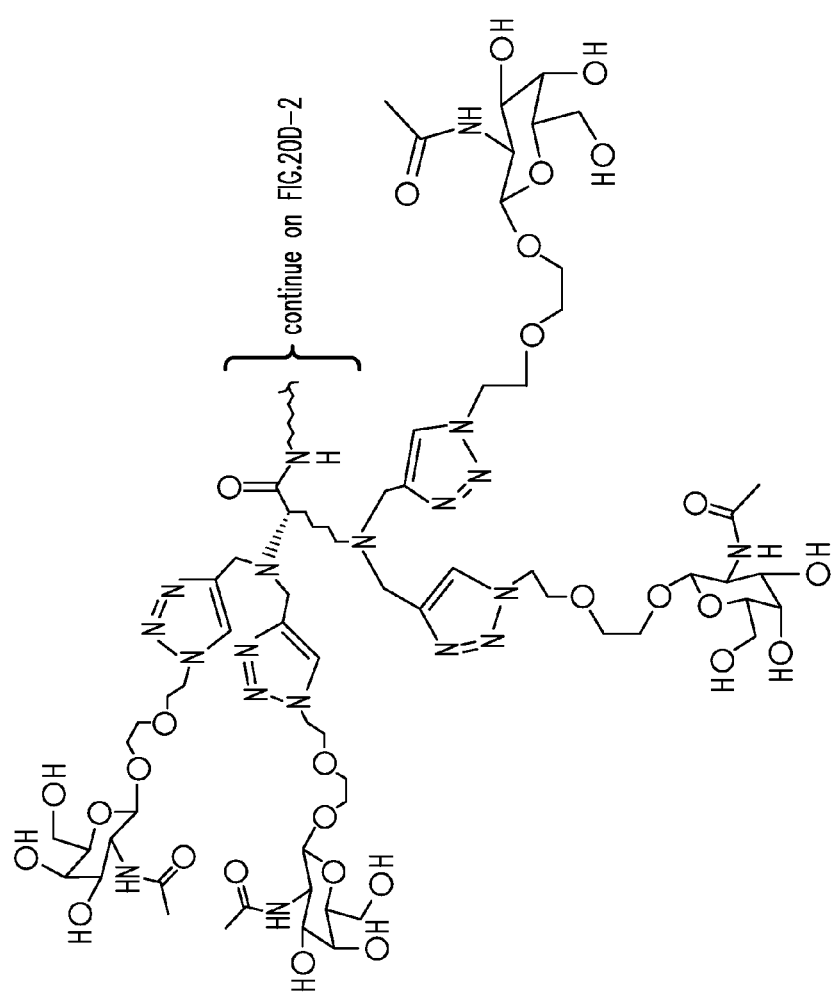
Figures 2, 20D:
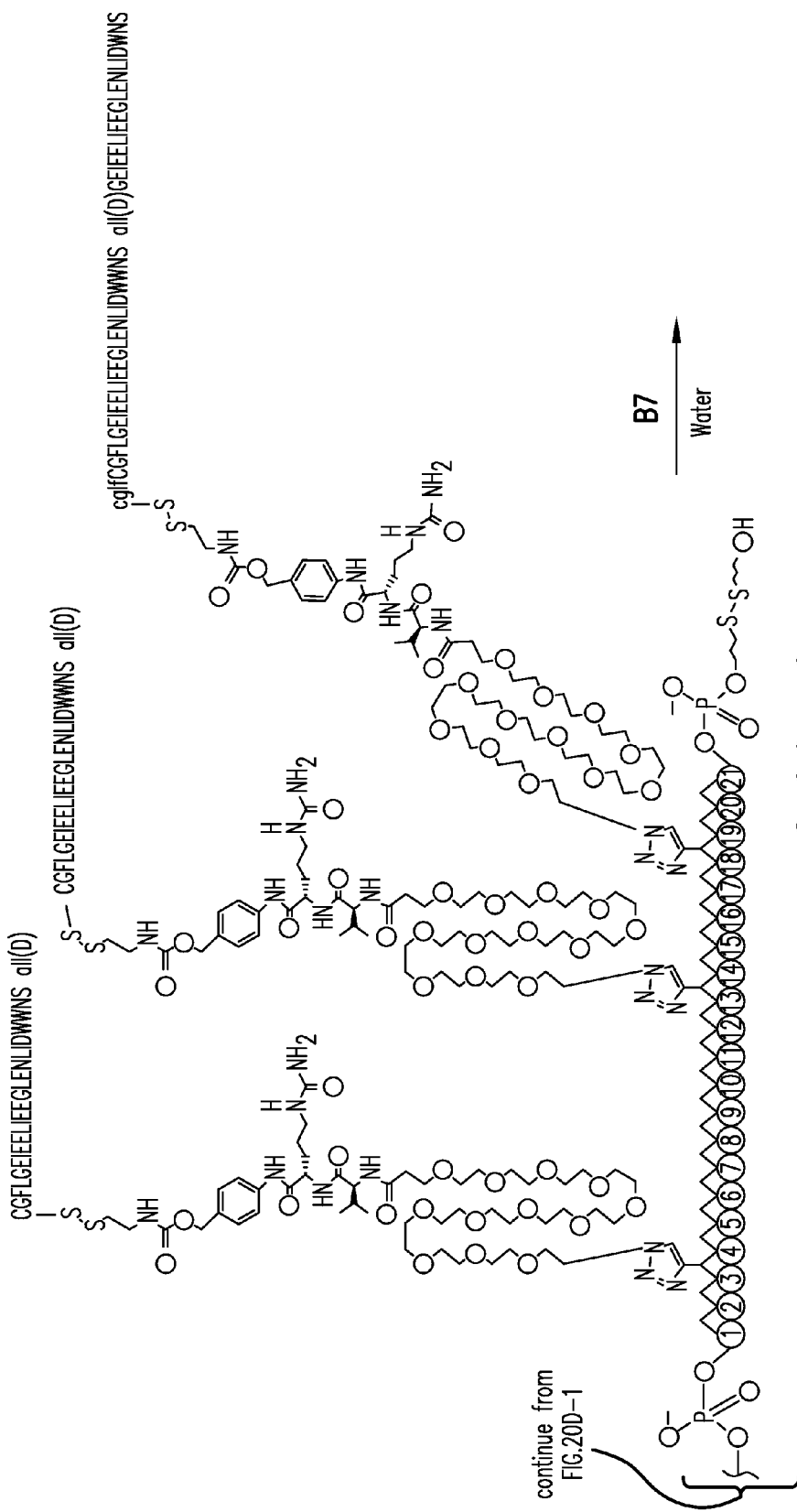
Figures 1, 20E:
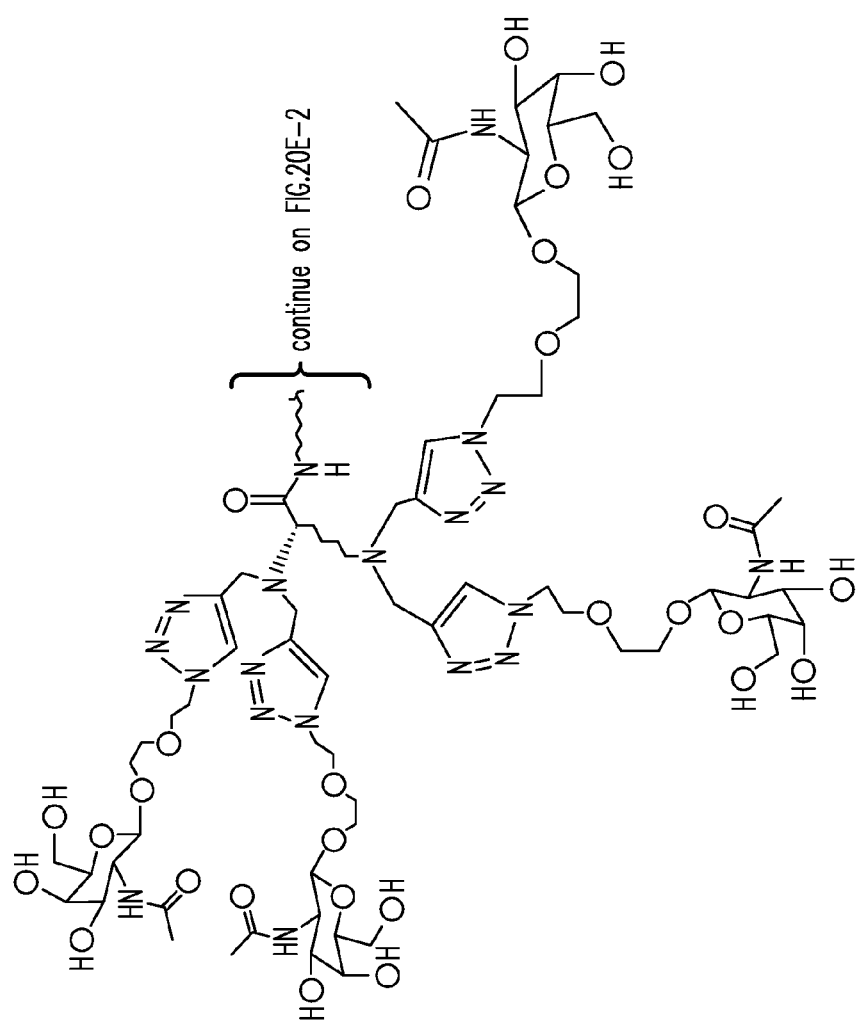
Figures 2, 20E:
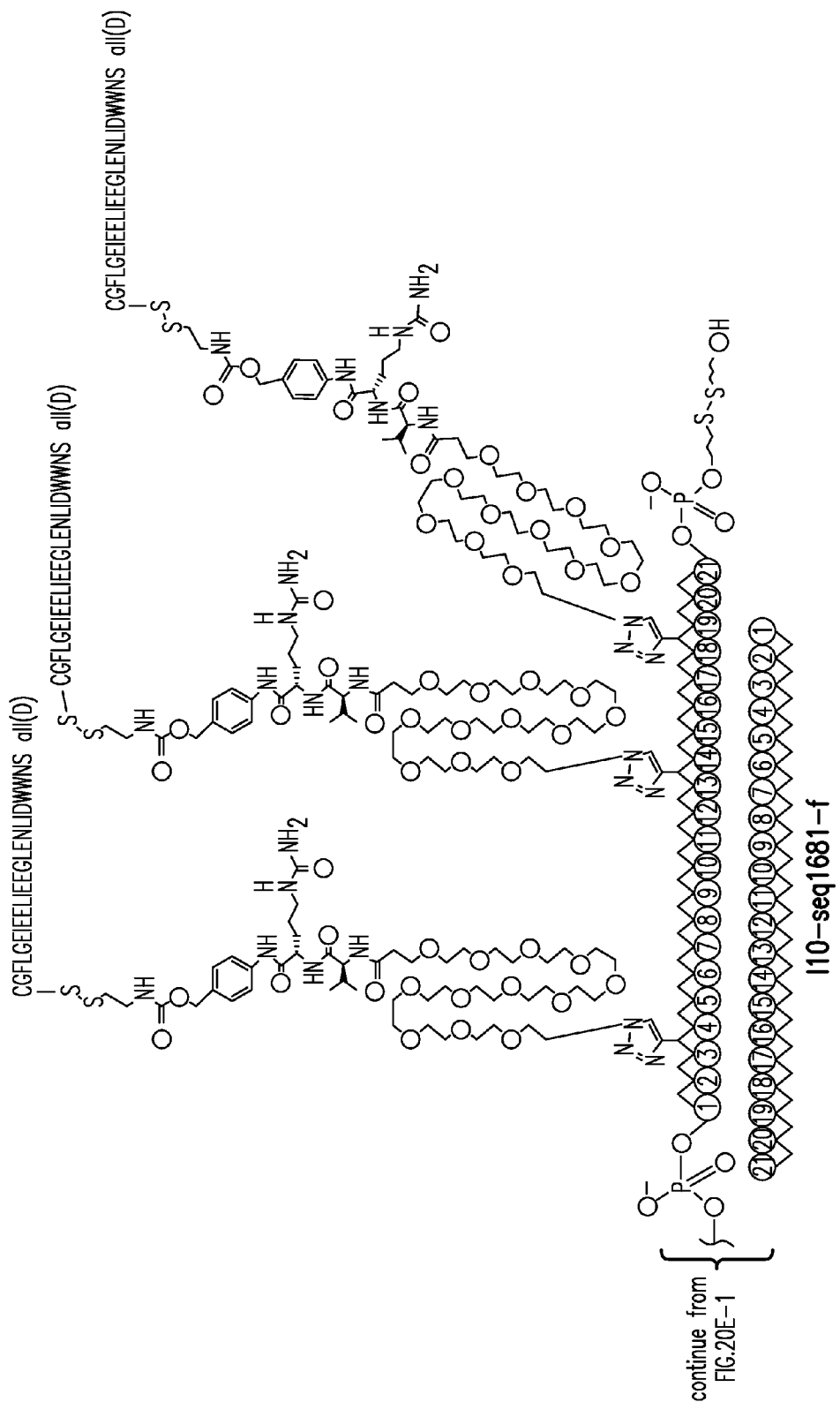
Figure 21A:
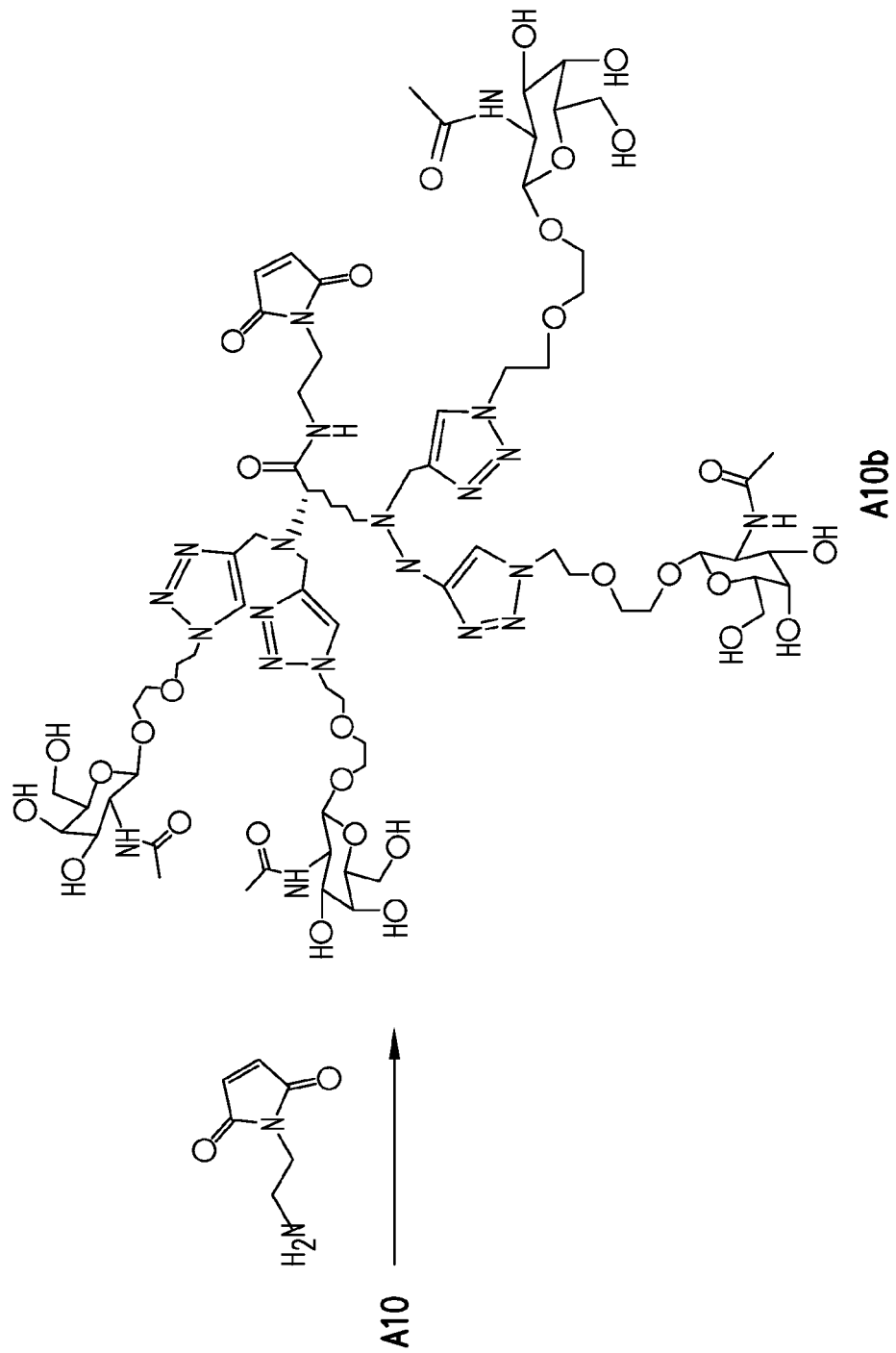
Figures 1, 21B:
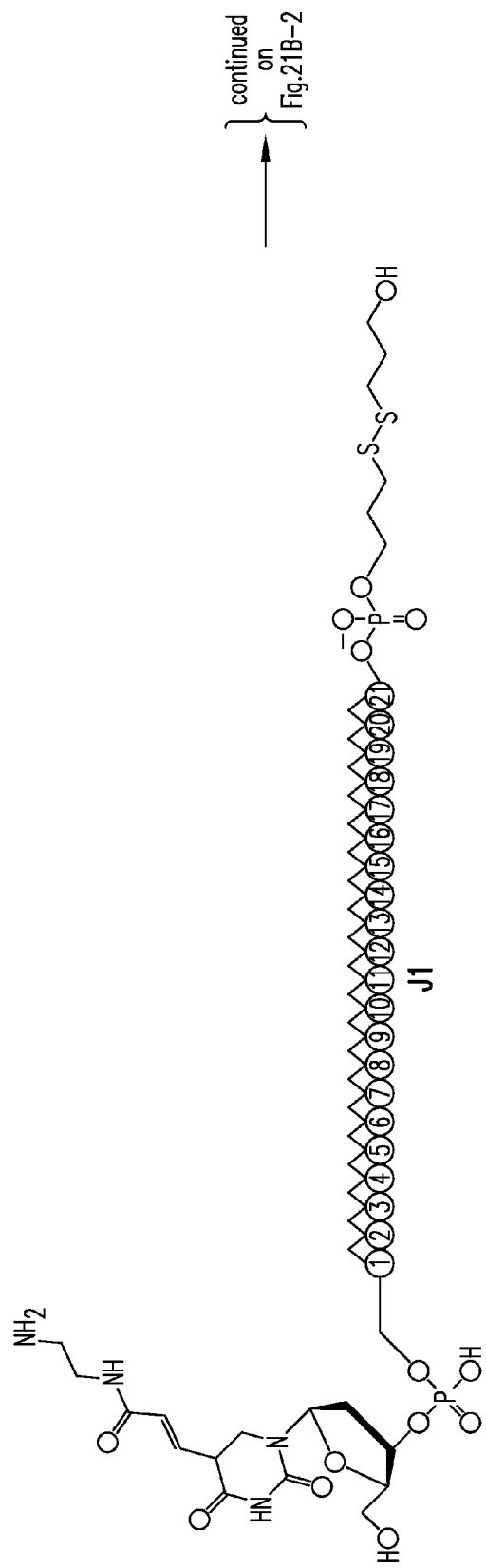
Figures 2, 21B:
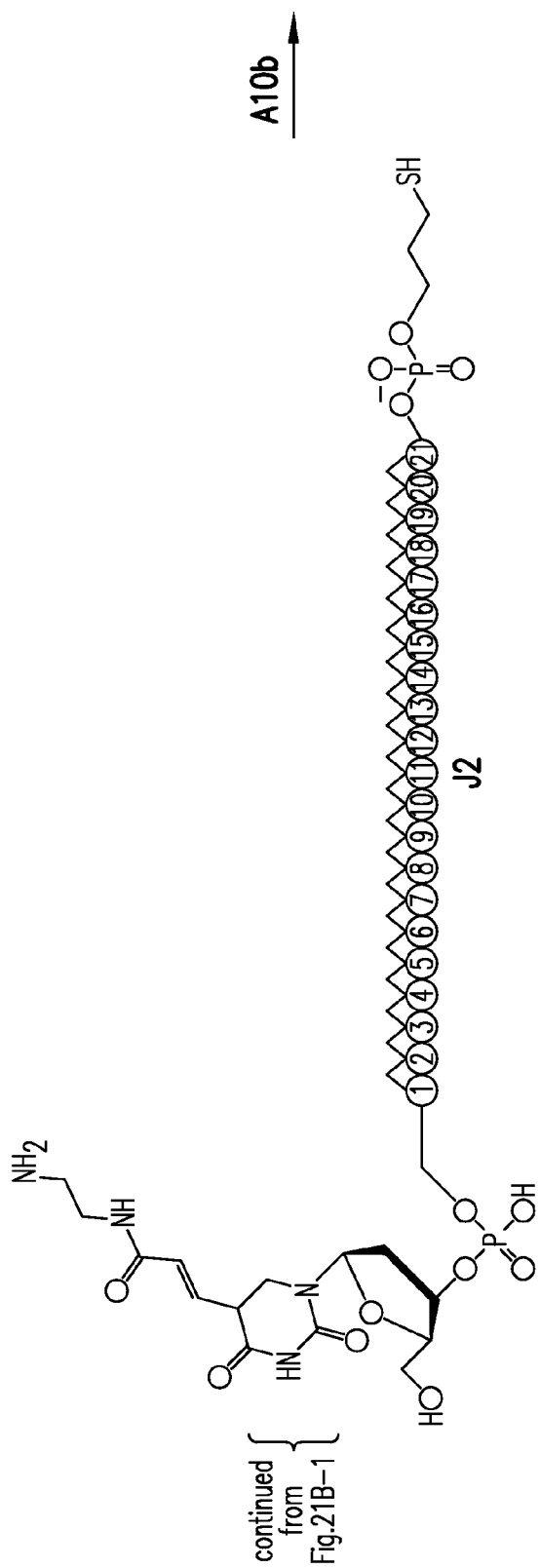
Figures 1, 21C:
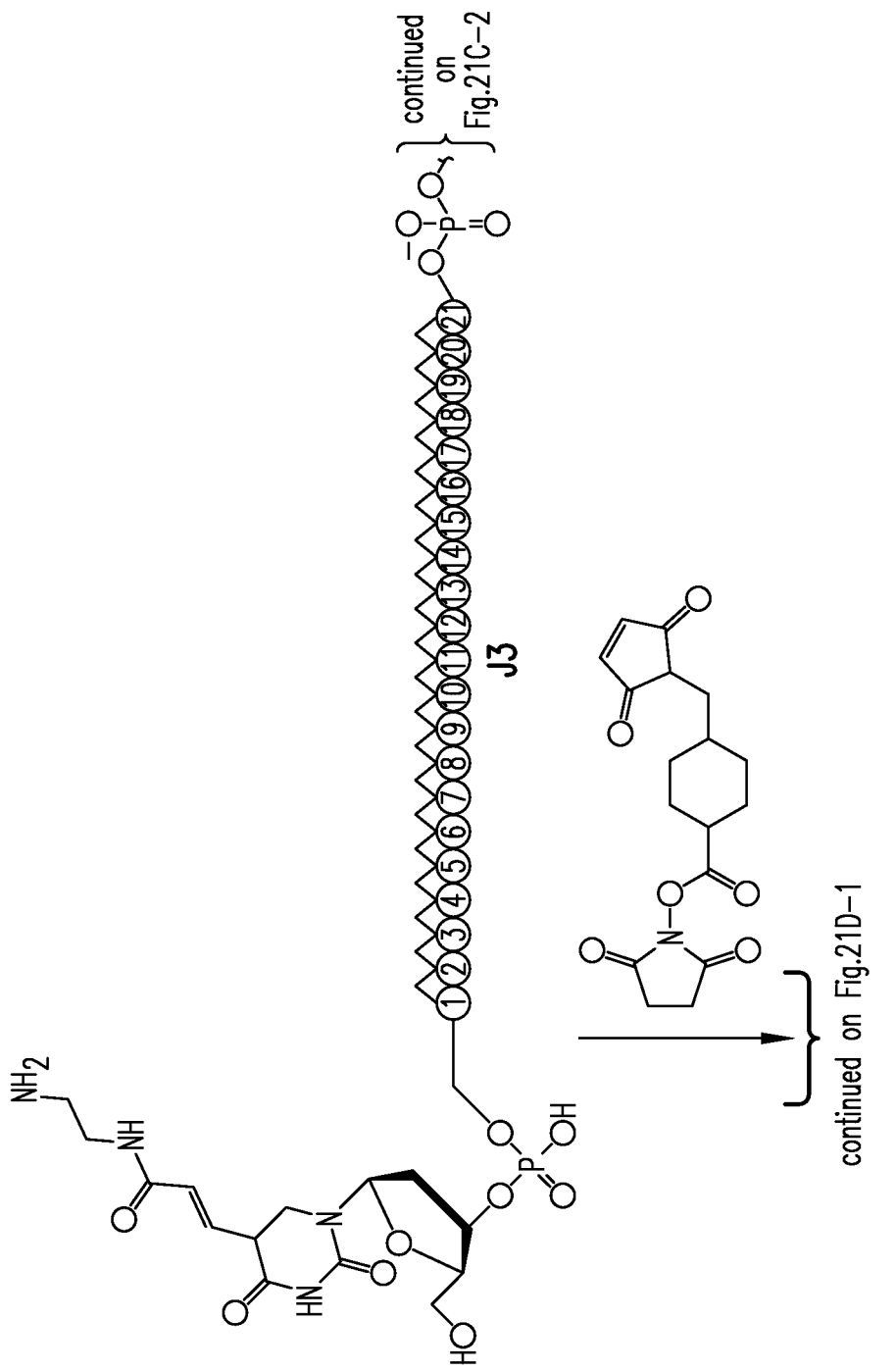
Figures 2, 21C:
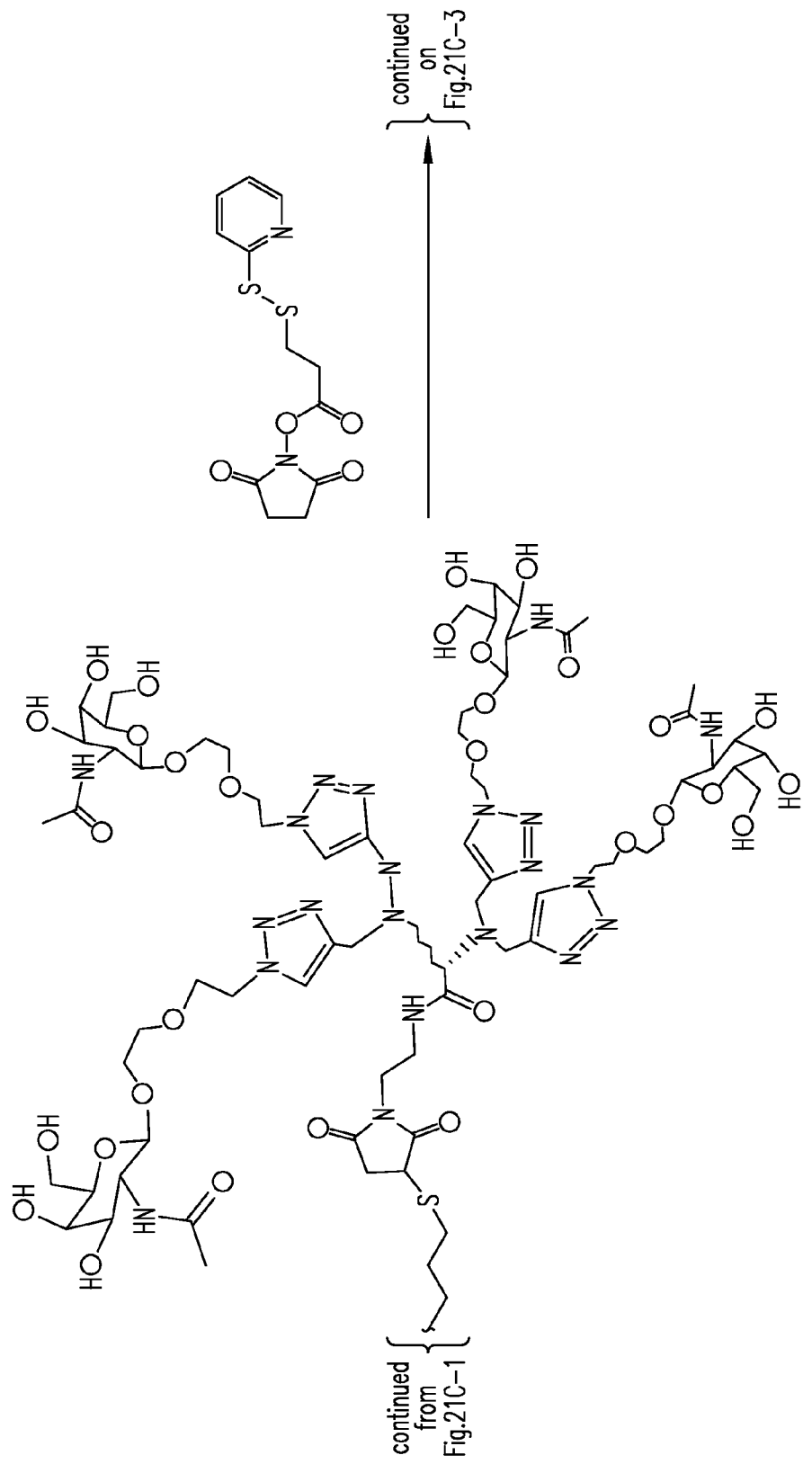
Figures 3, 21C:
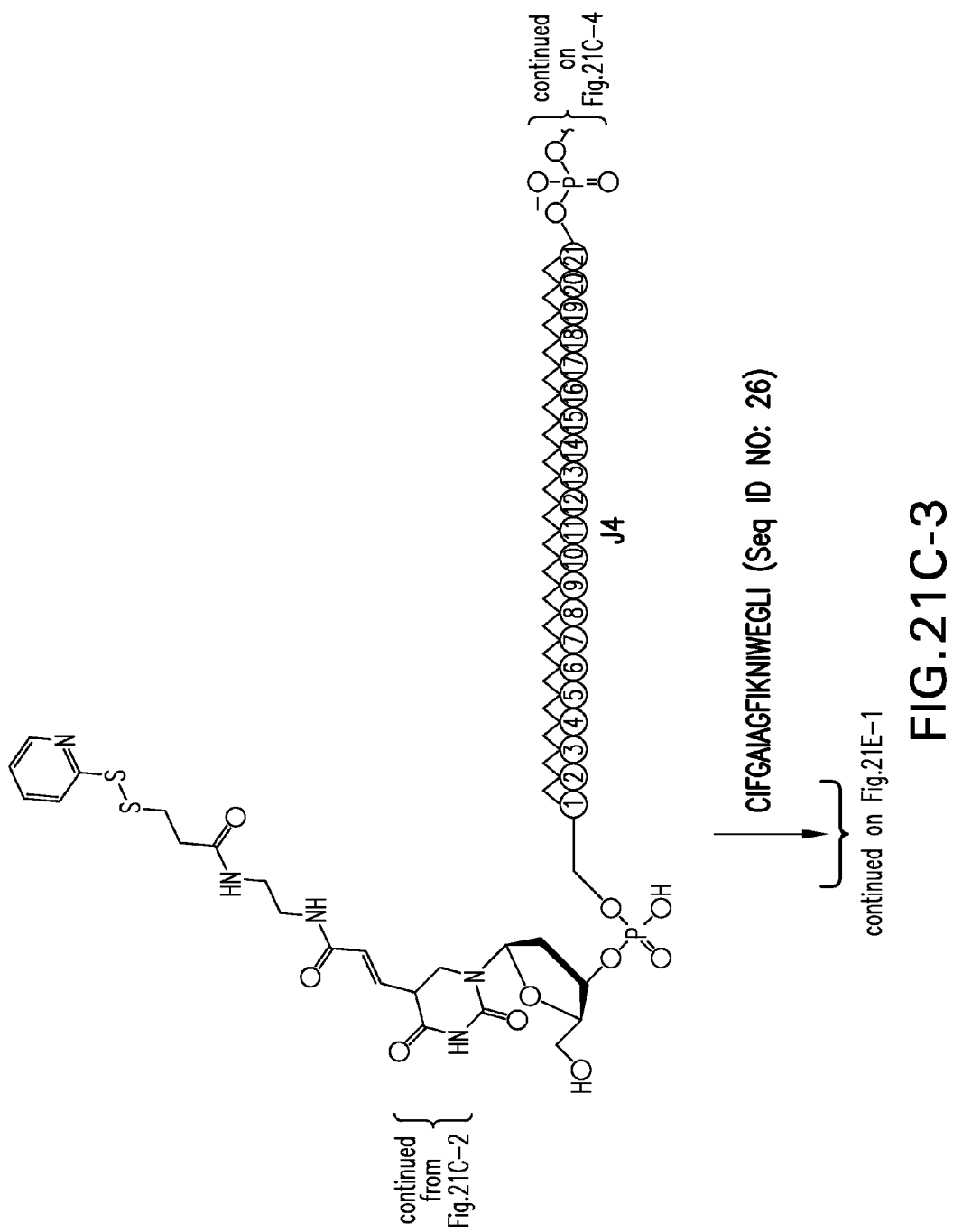
Figures 4, 21C:
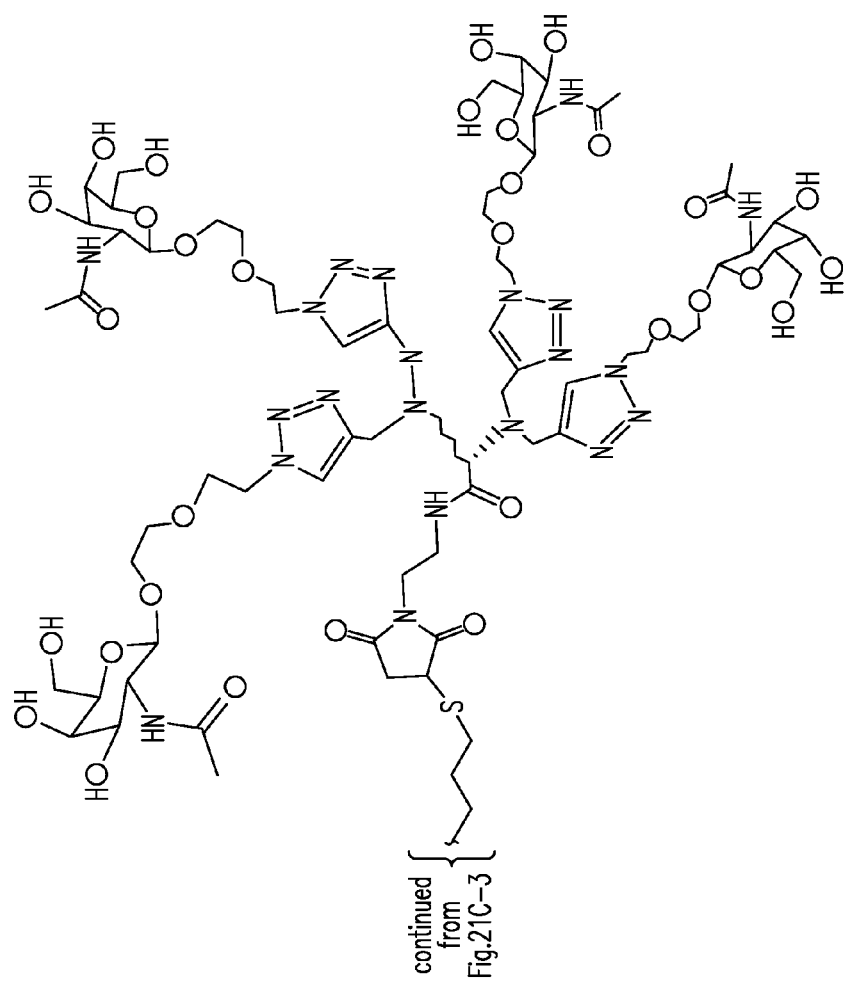
Figures 1, 21D:
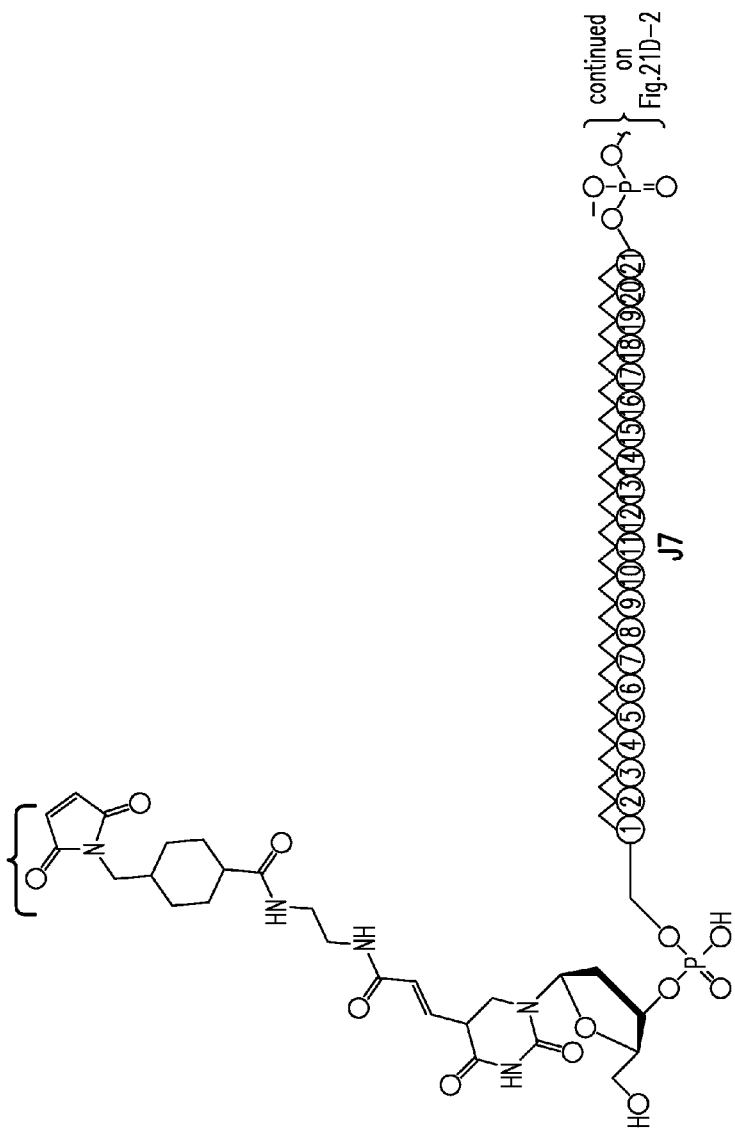
Figures 2, 21D:
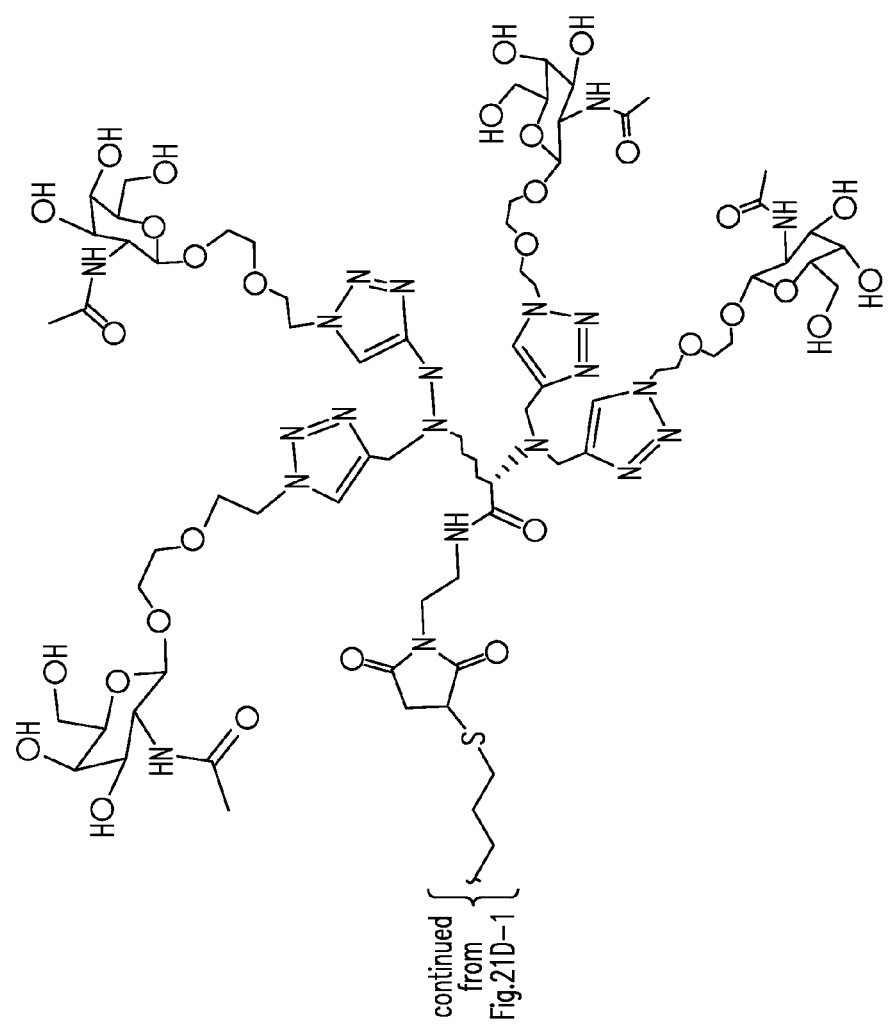
Figures 1, 21E:
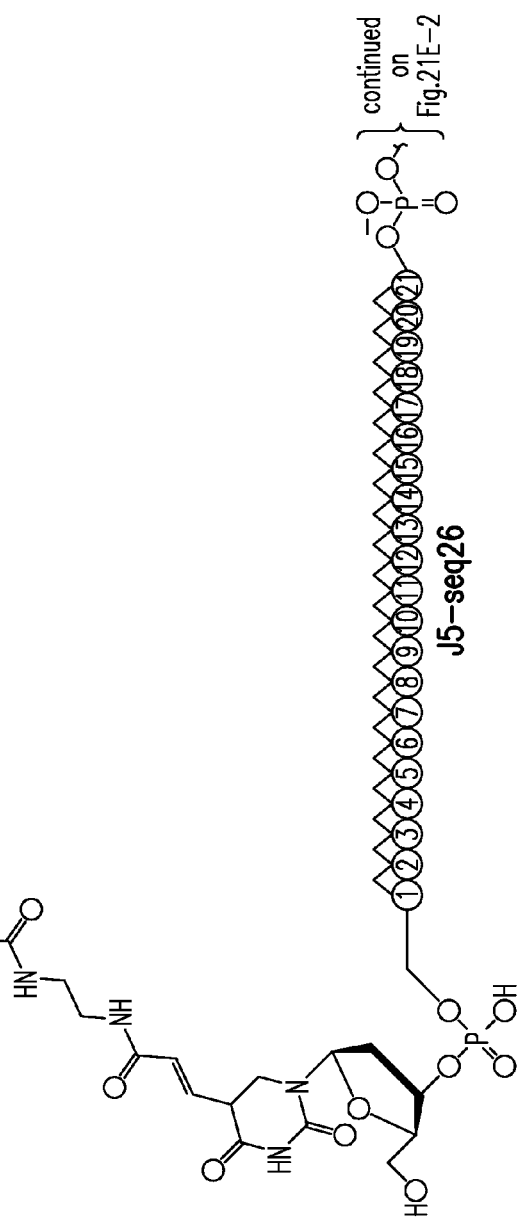
Figures 2, 21E:
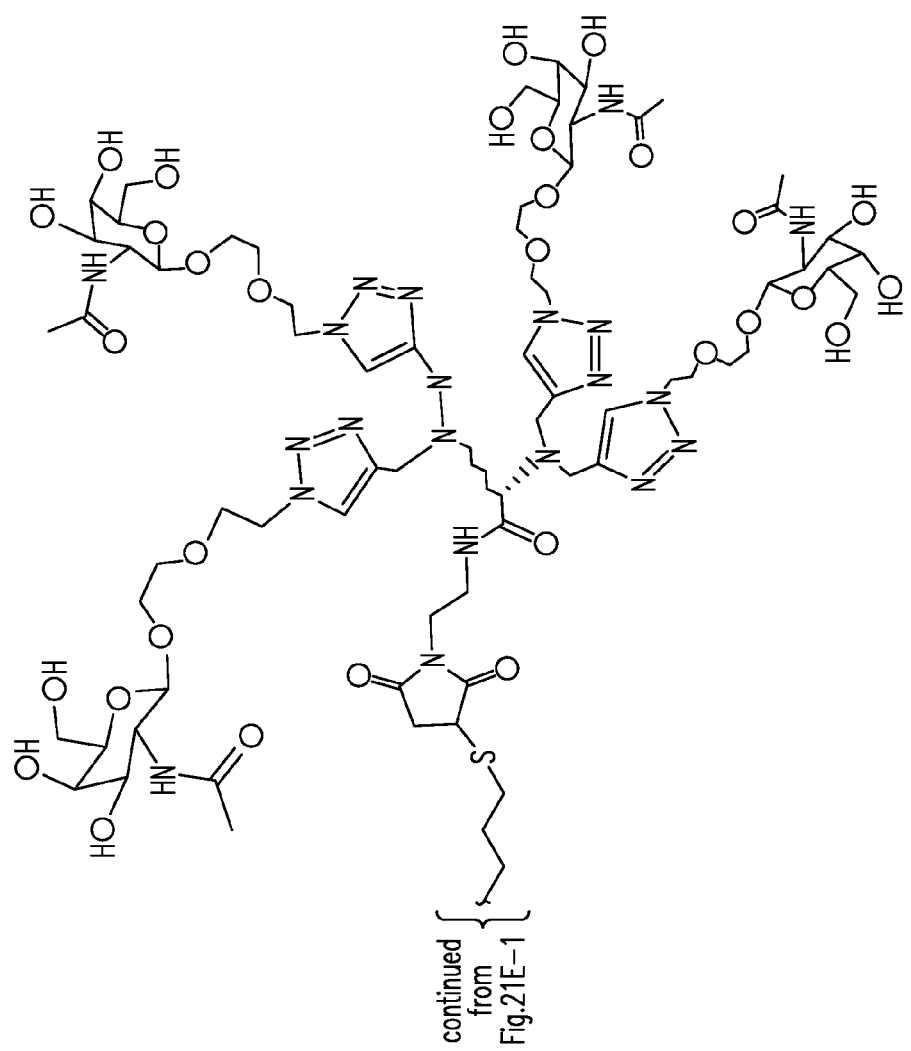
Figures 1, 21F:
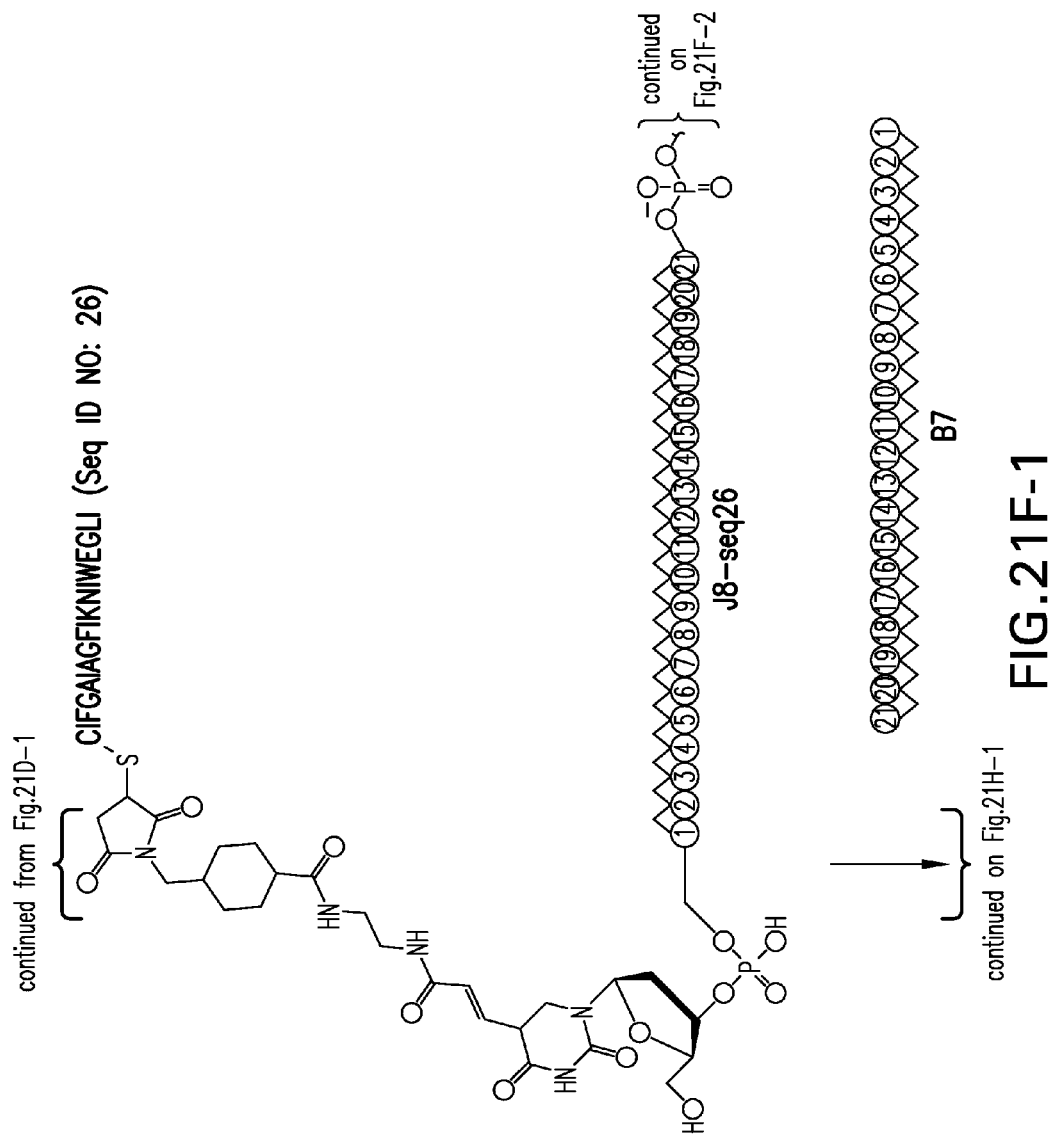
Figures 2, 21F:
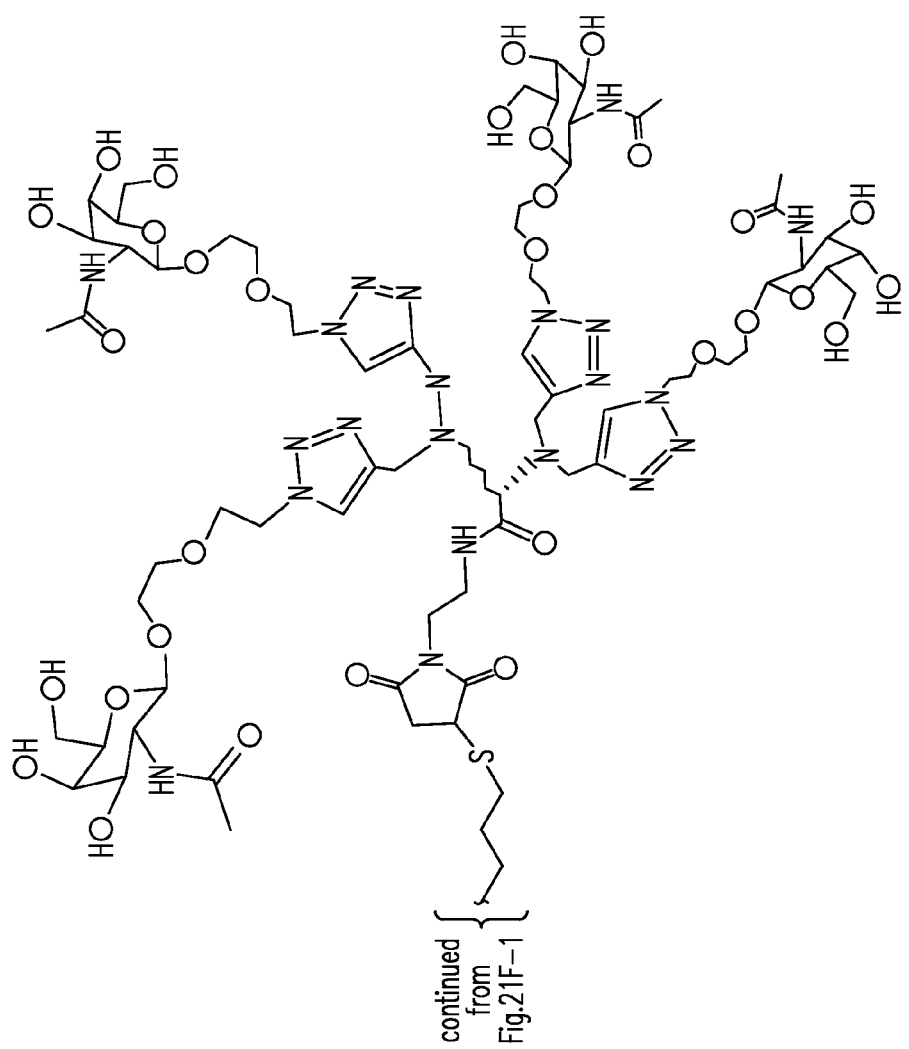
Figures 1, 21G:
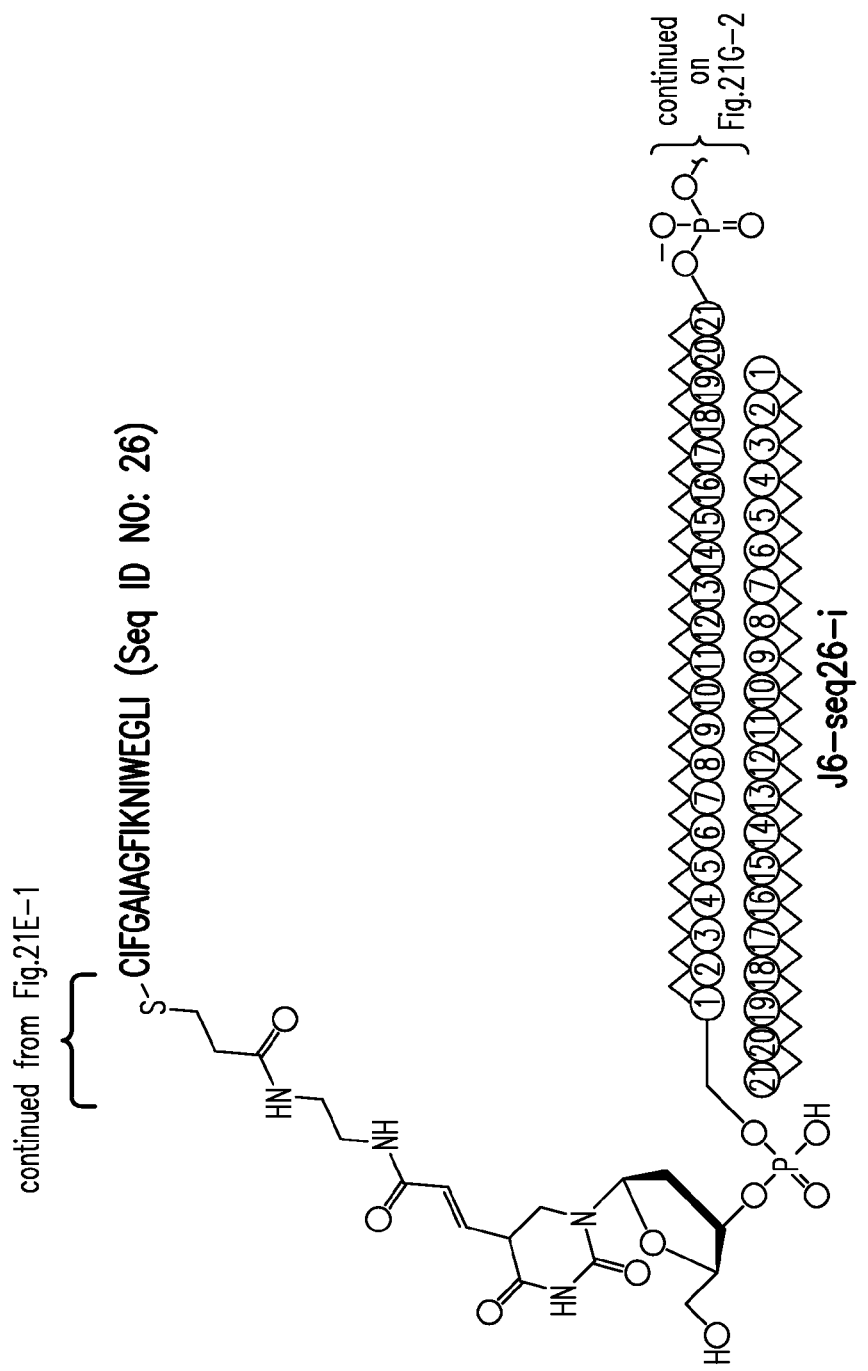
Figures 2, 21G:
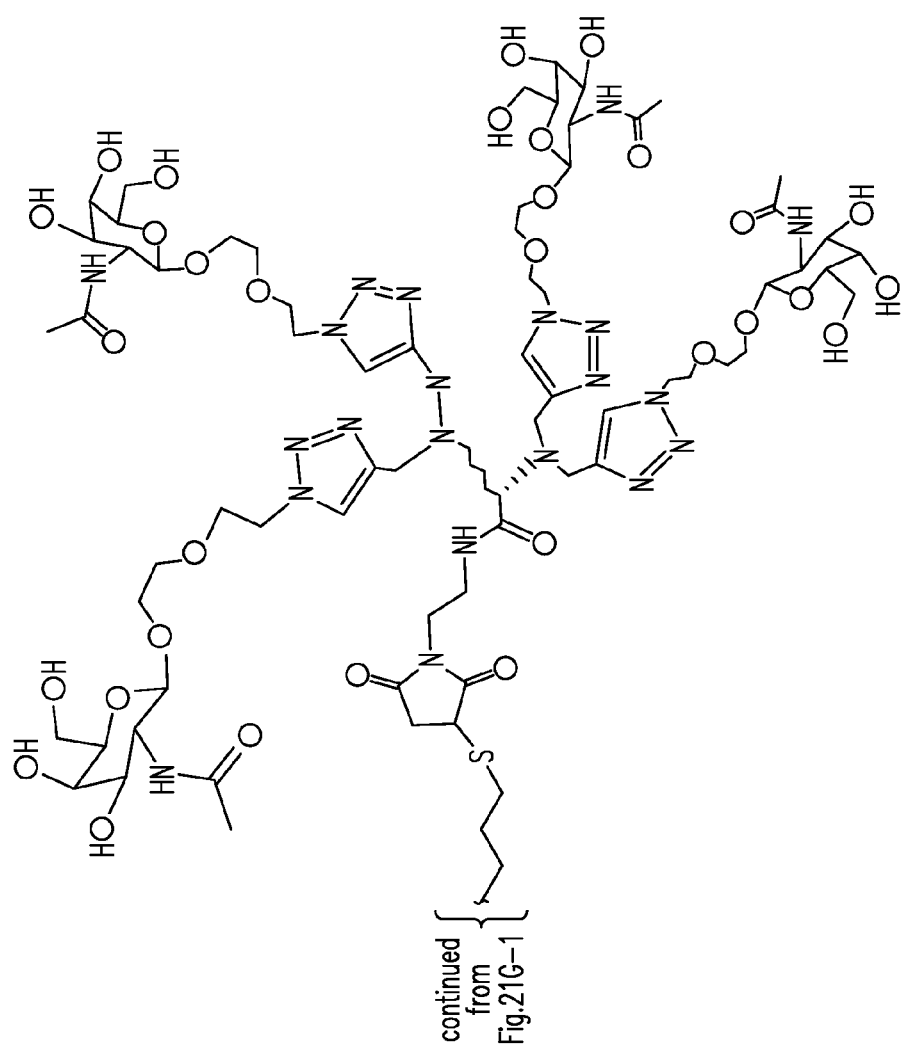
Figures 1, 21H:
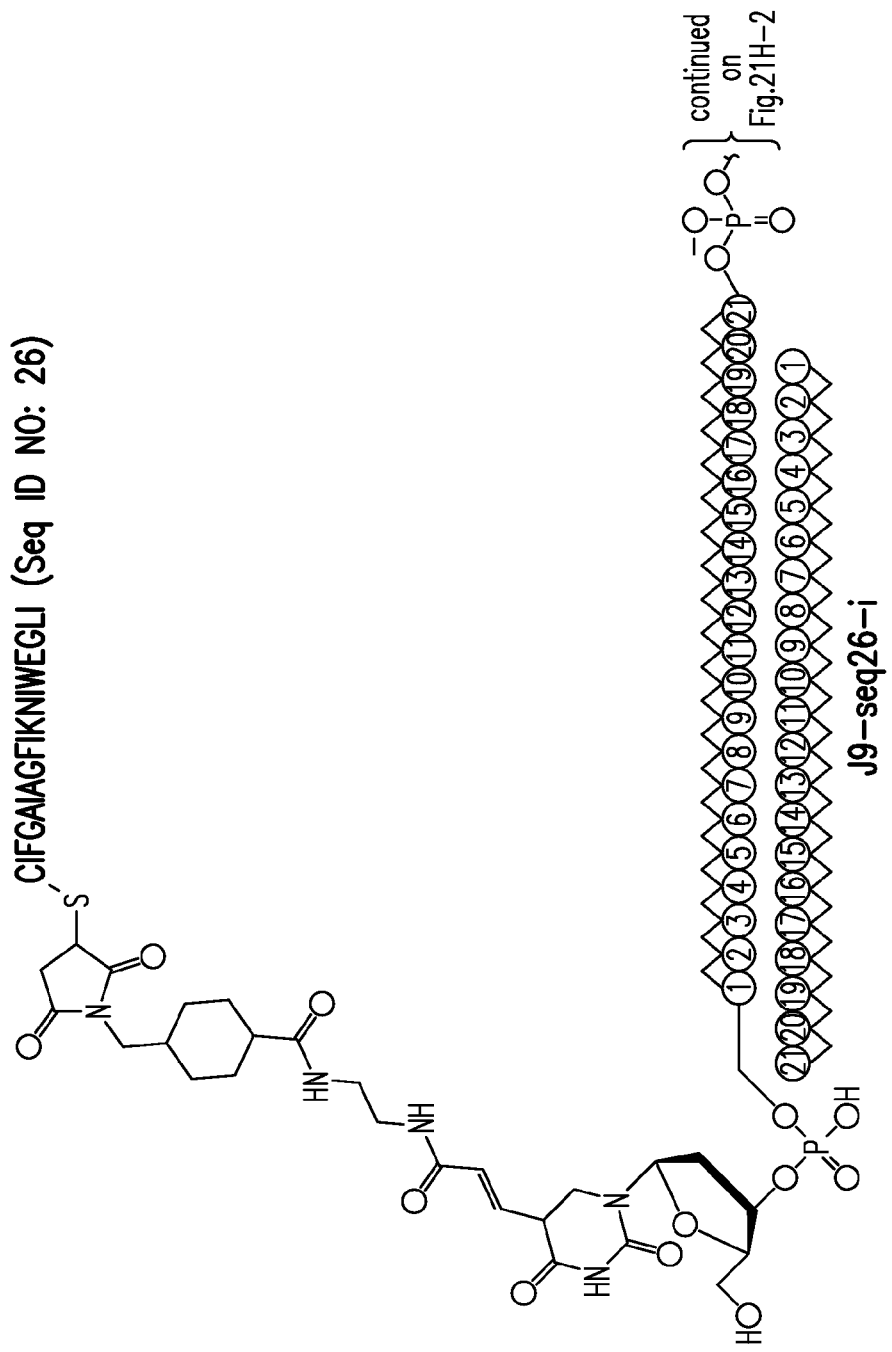
Figures 2, 21H:
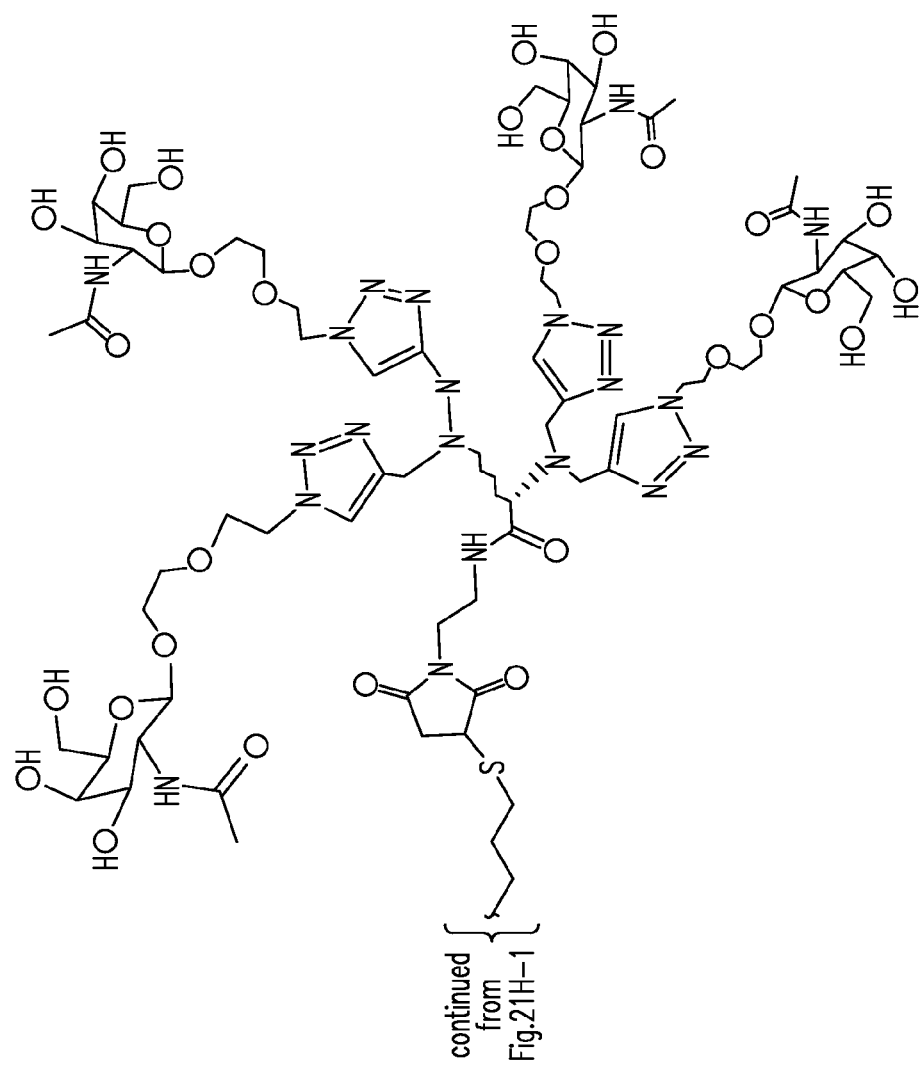
Figures 1, 22A:
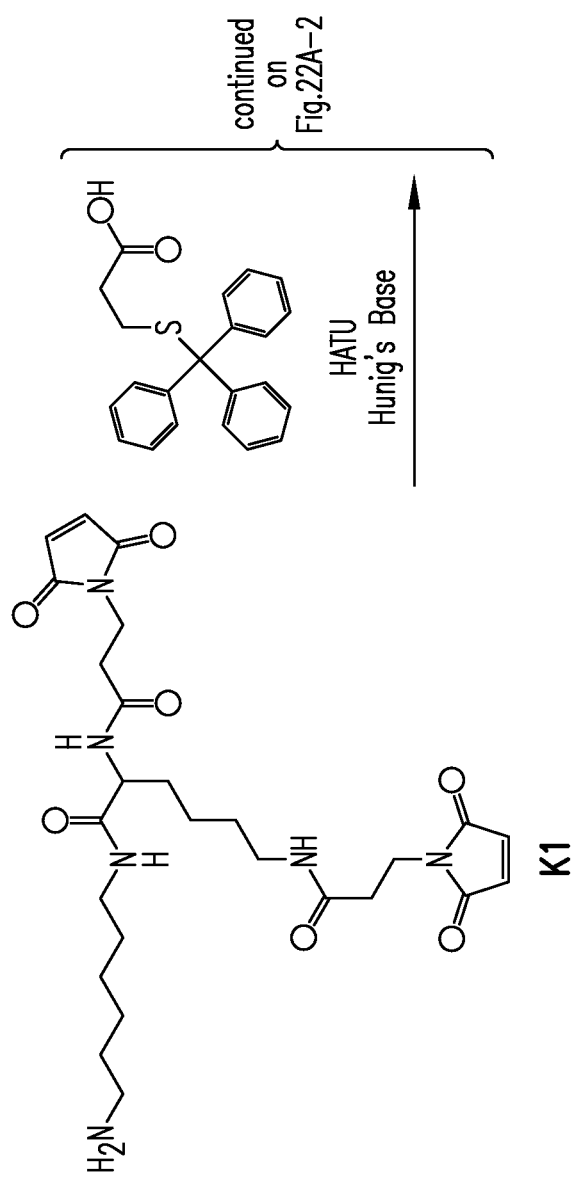
Figures 2, 22A:
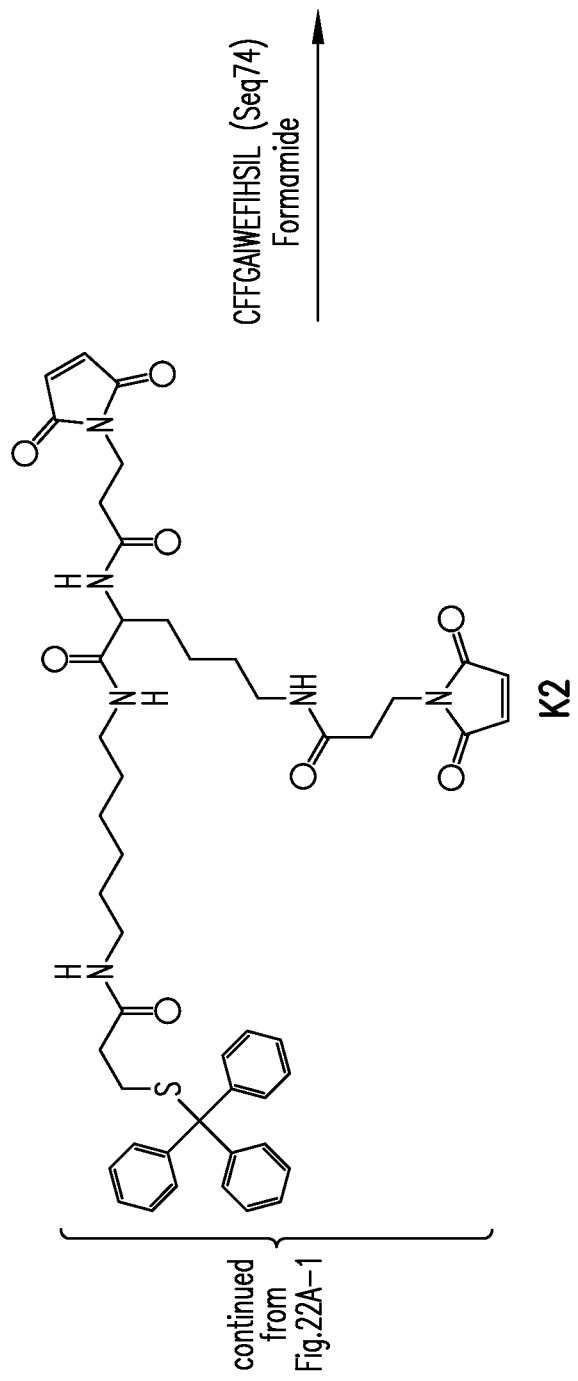
Figures 1, 22B:
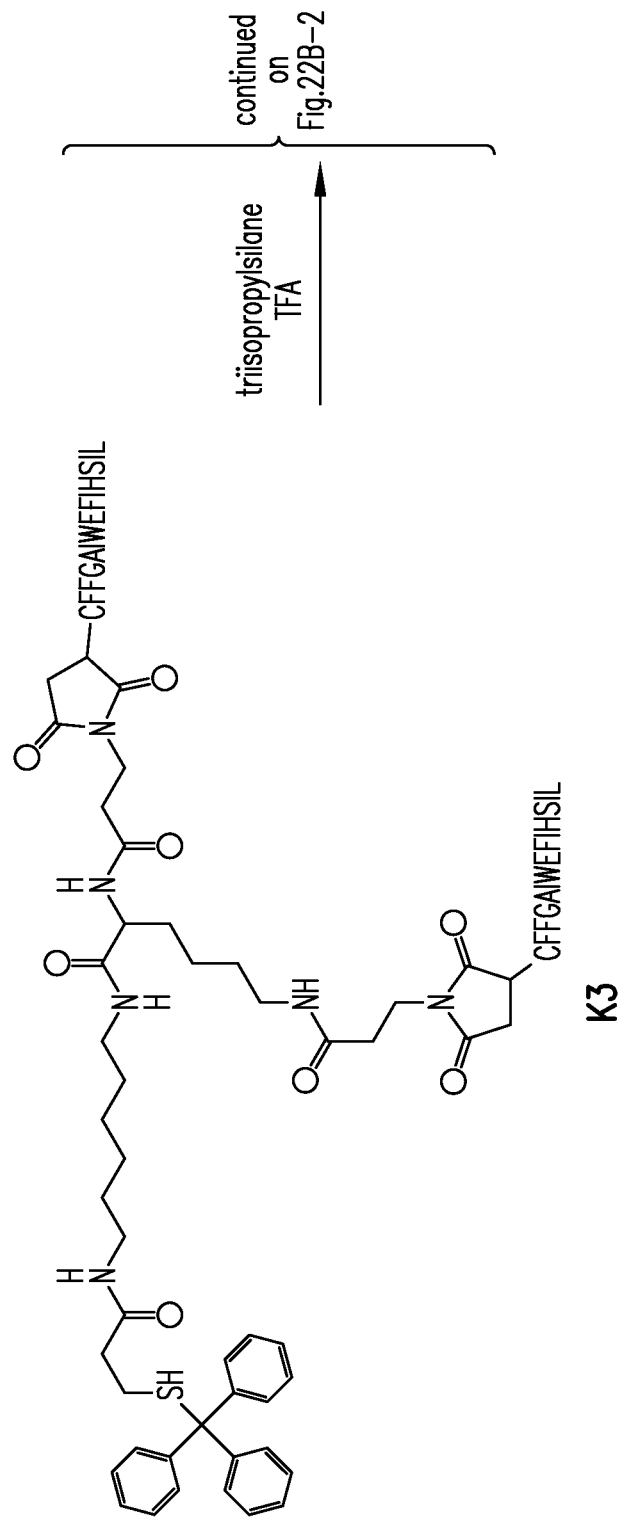
Figures 2, 22B:
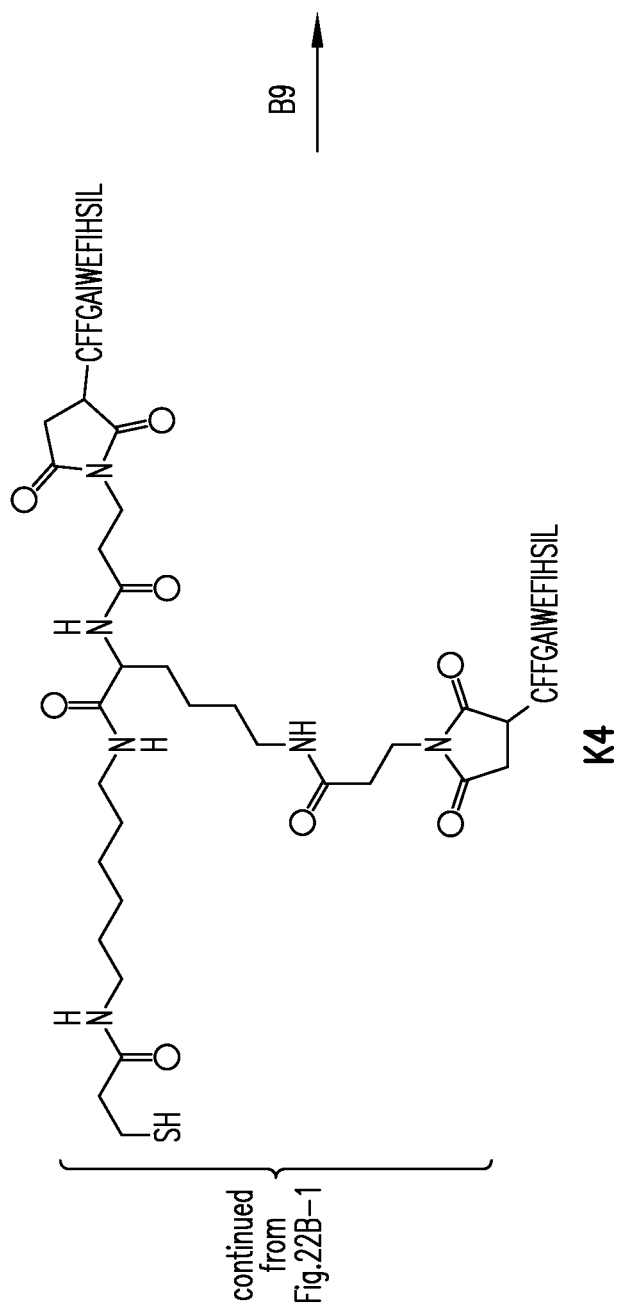
Figures 1, 22C:
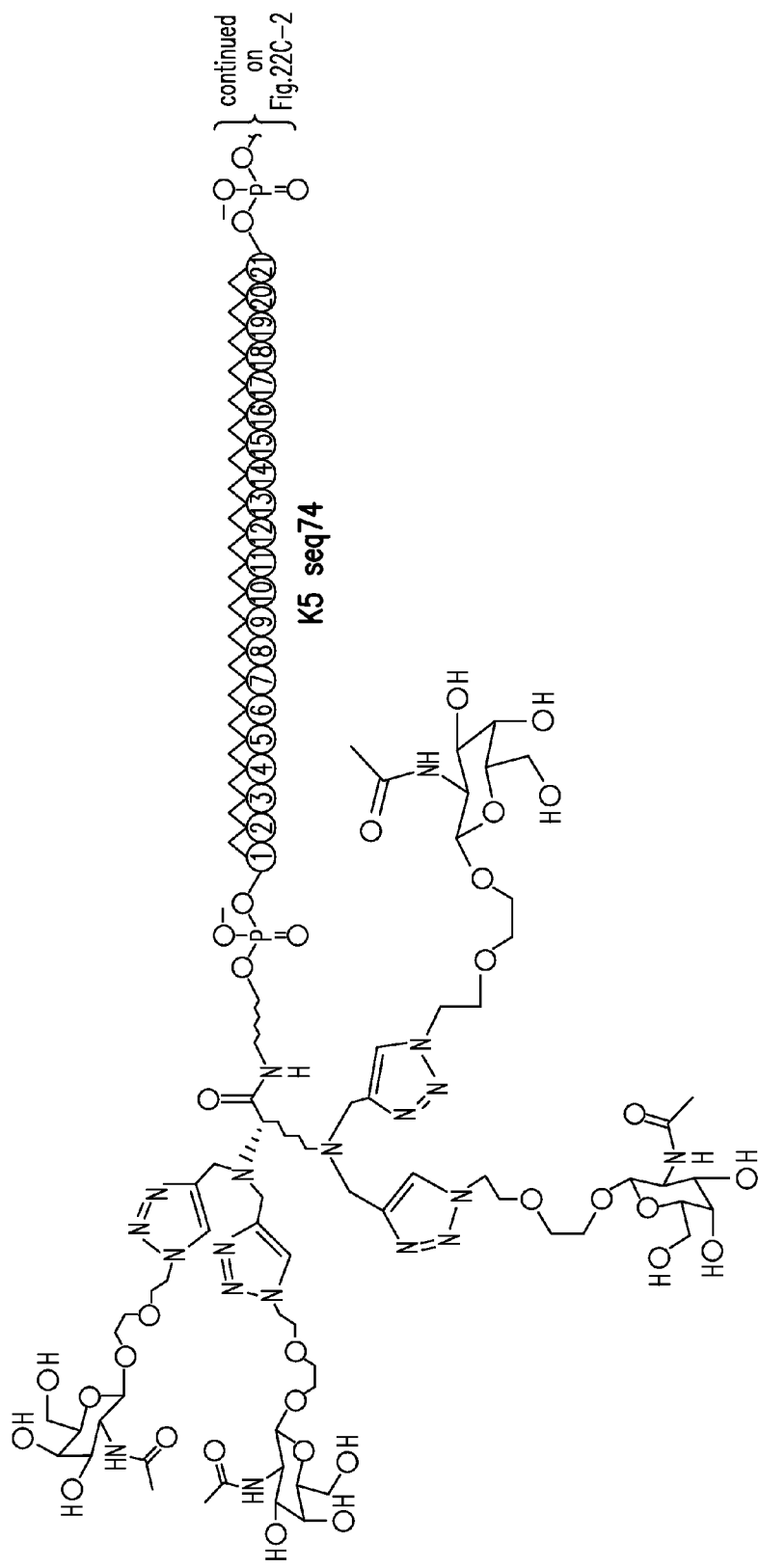
Figures 2, 22C:
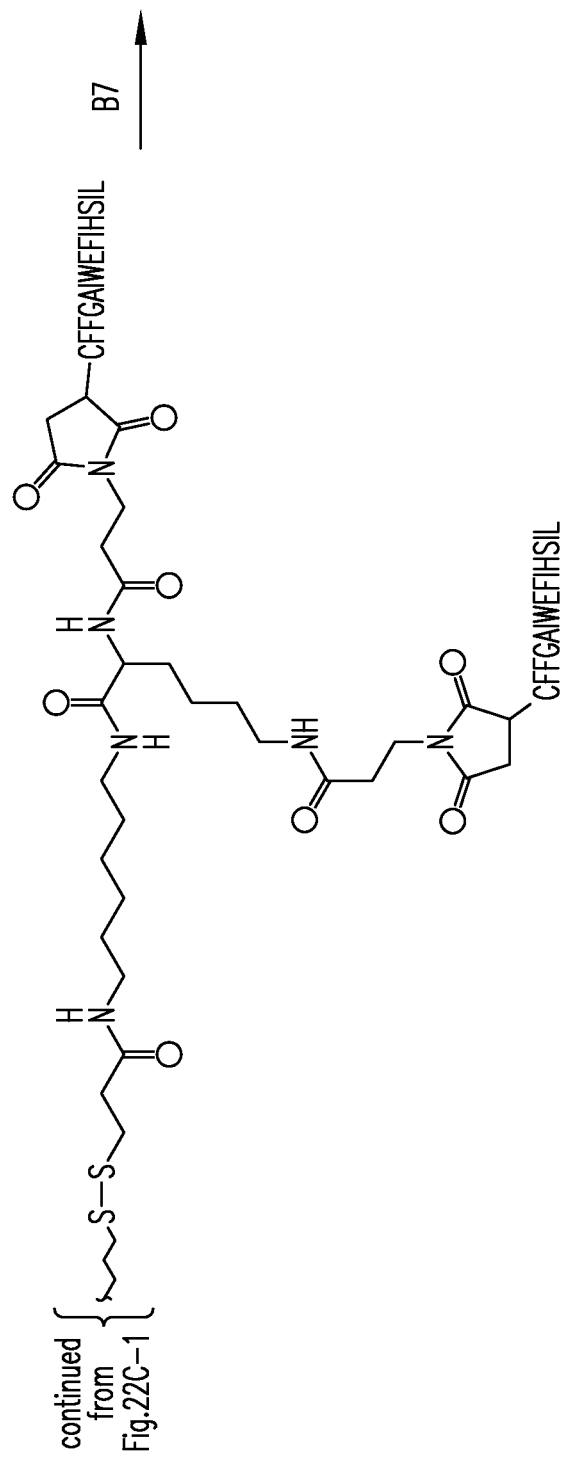
Figures 1, 22D:
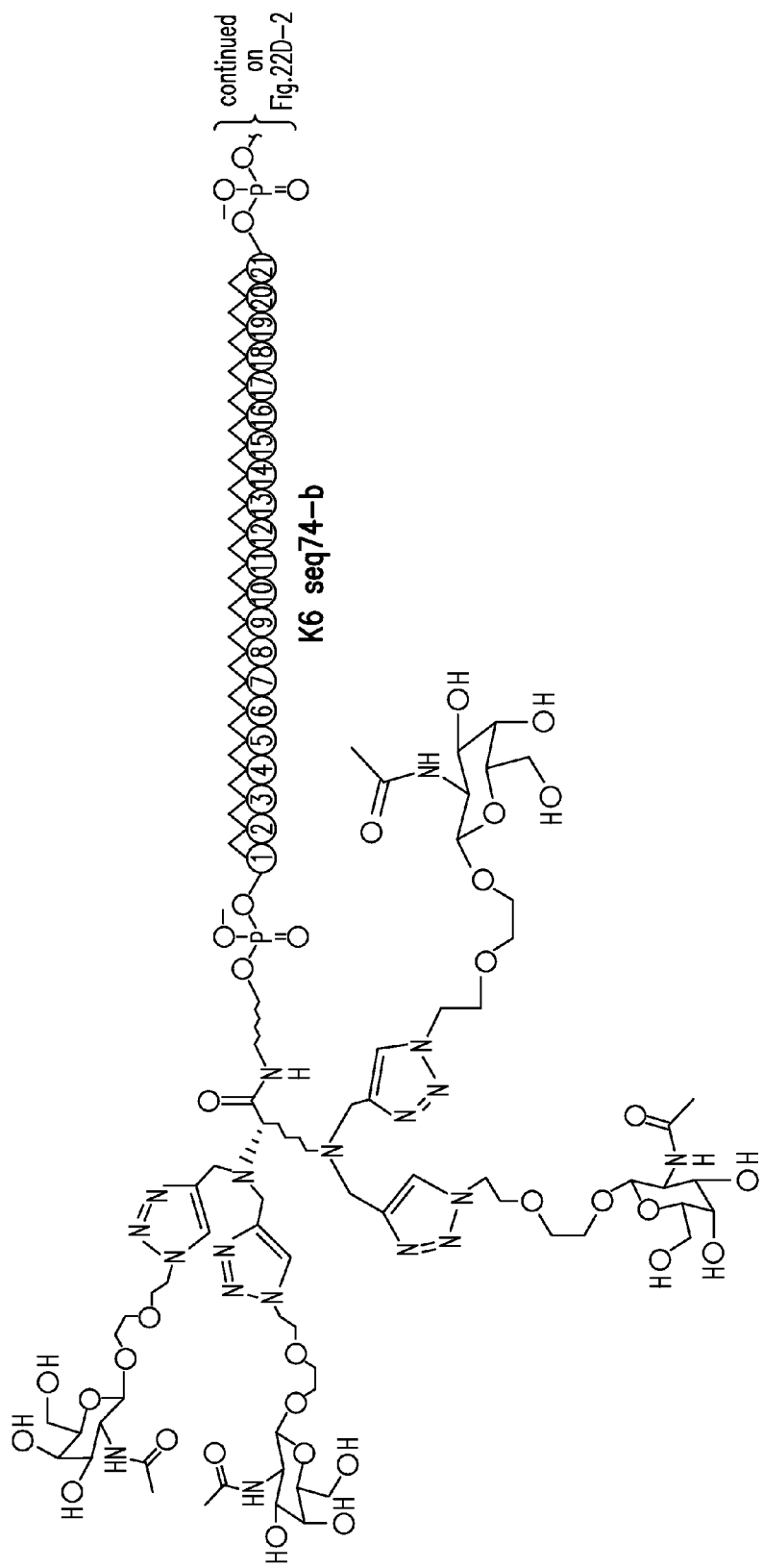
Figures 2, 22D:
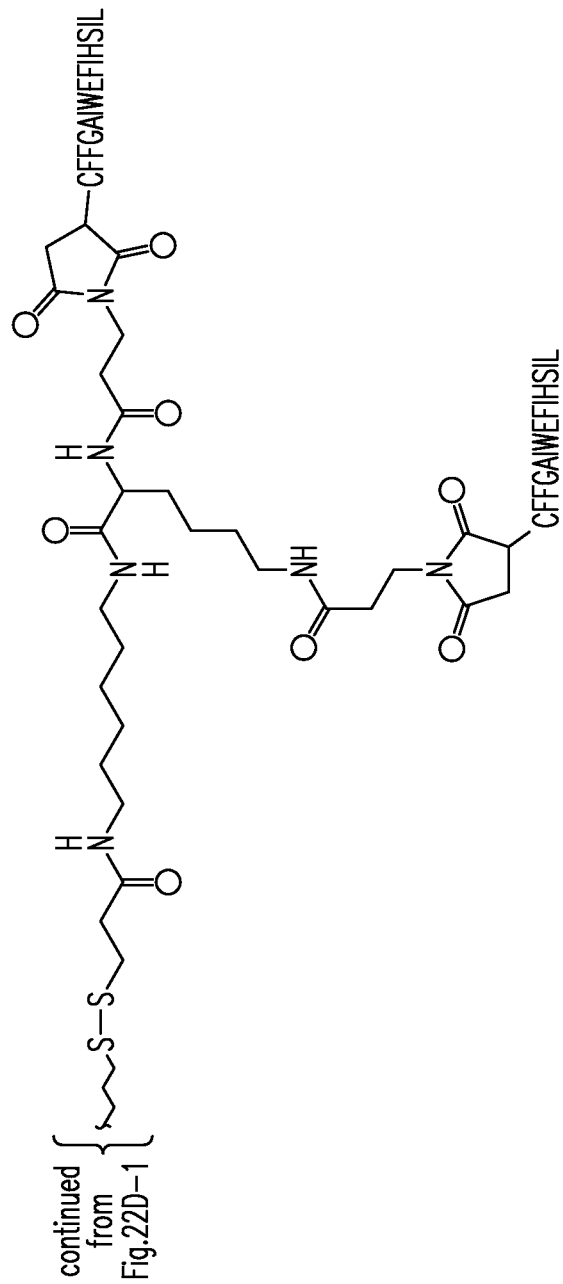
Figure 23A:
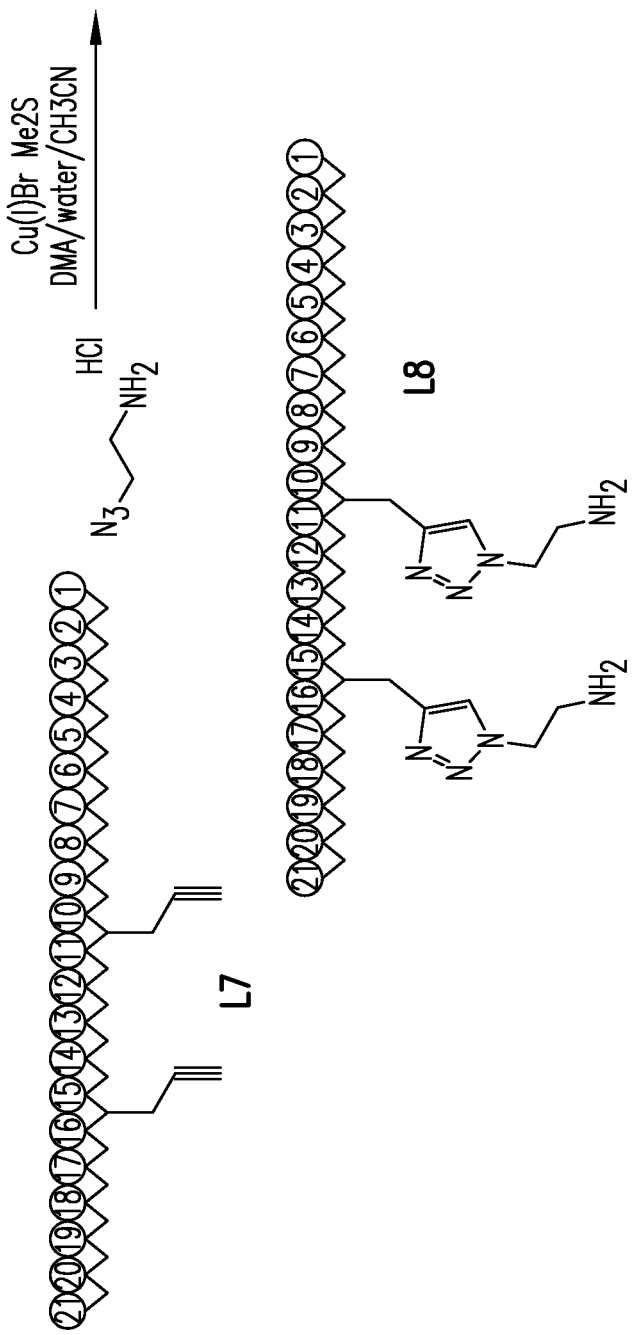
Figures 1, 23B:
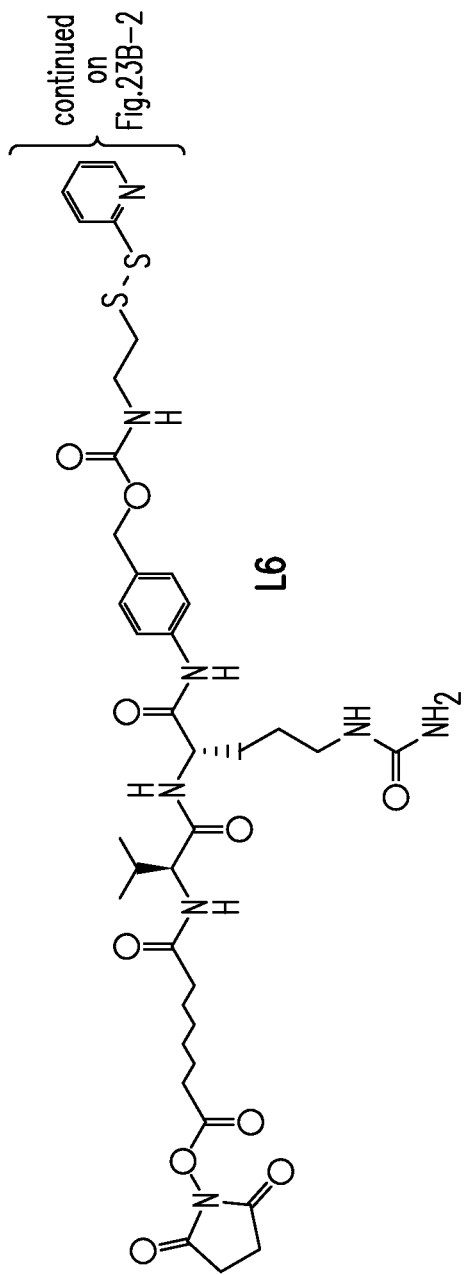
Figures 2, 23B:
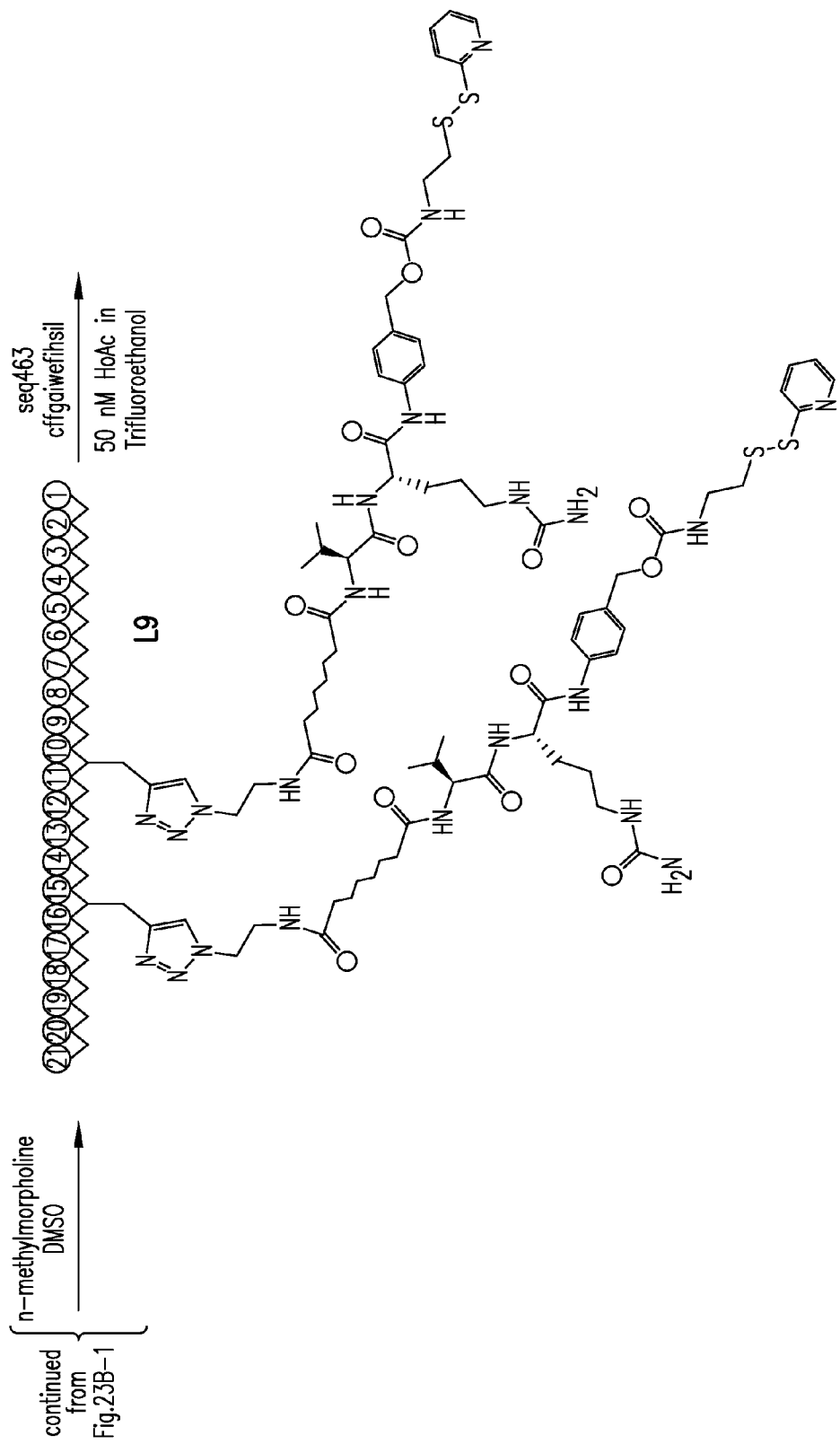
Figures 1, 23C:
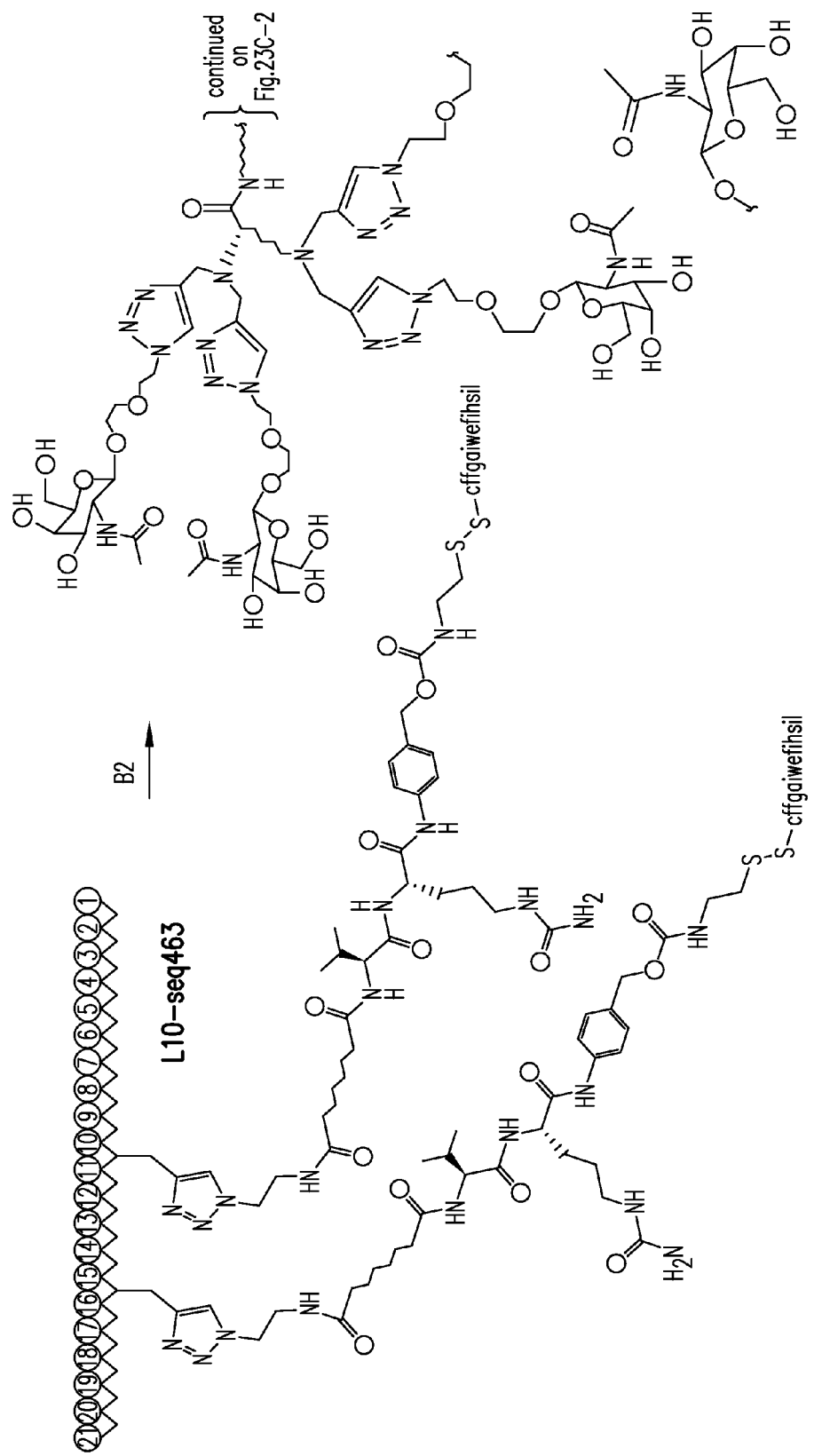
Figures 2, 23C:
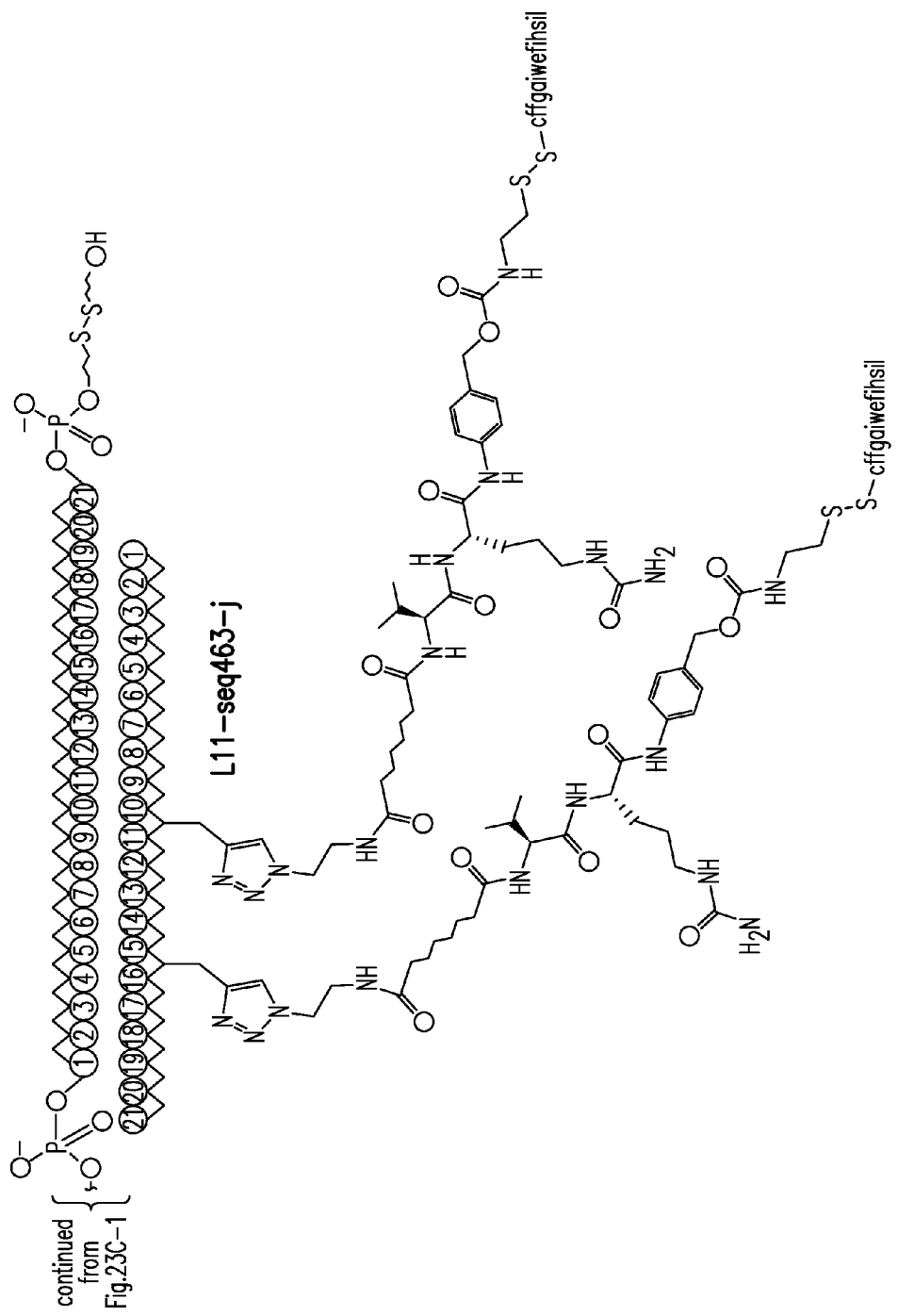
Figures 1, 24A:
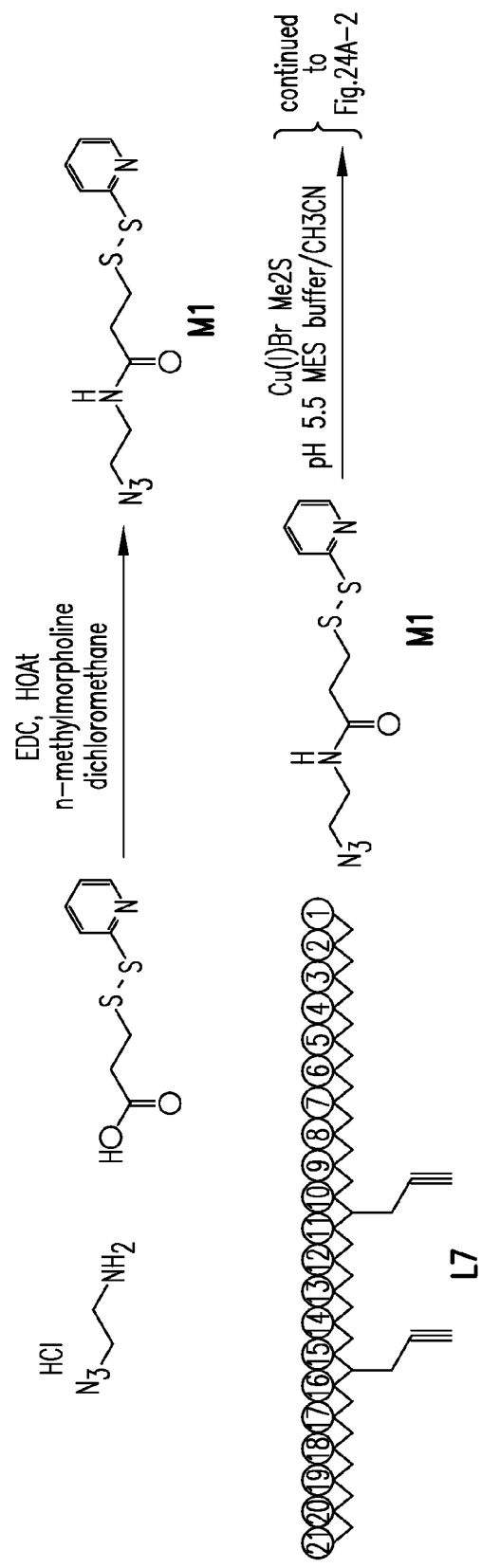
Figures 2, 24A:
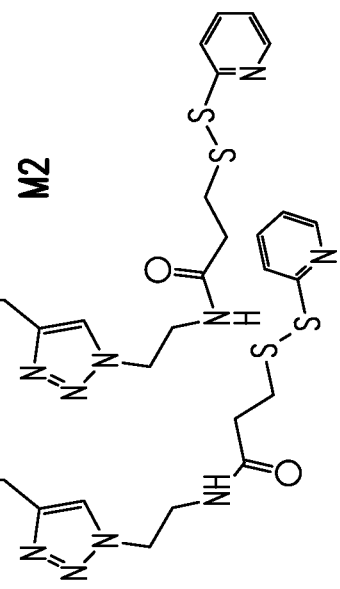
Figures 1, 24B:
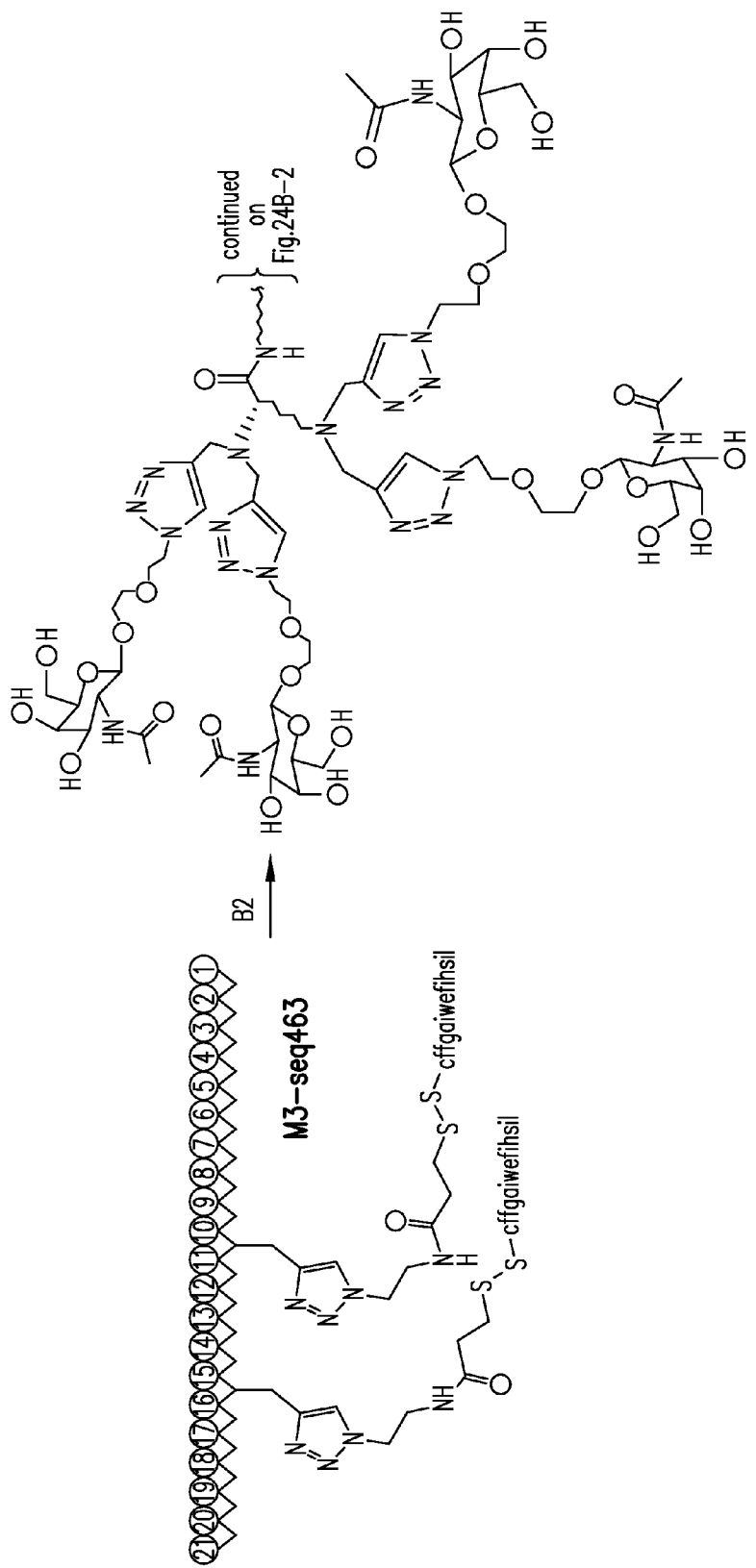
Figures 2, 24B:
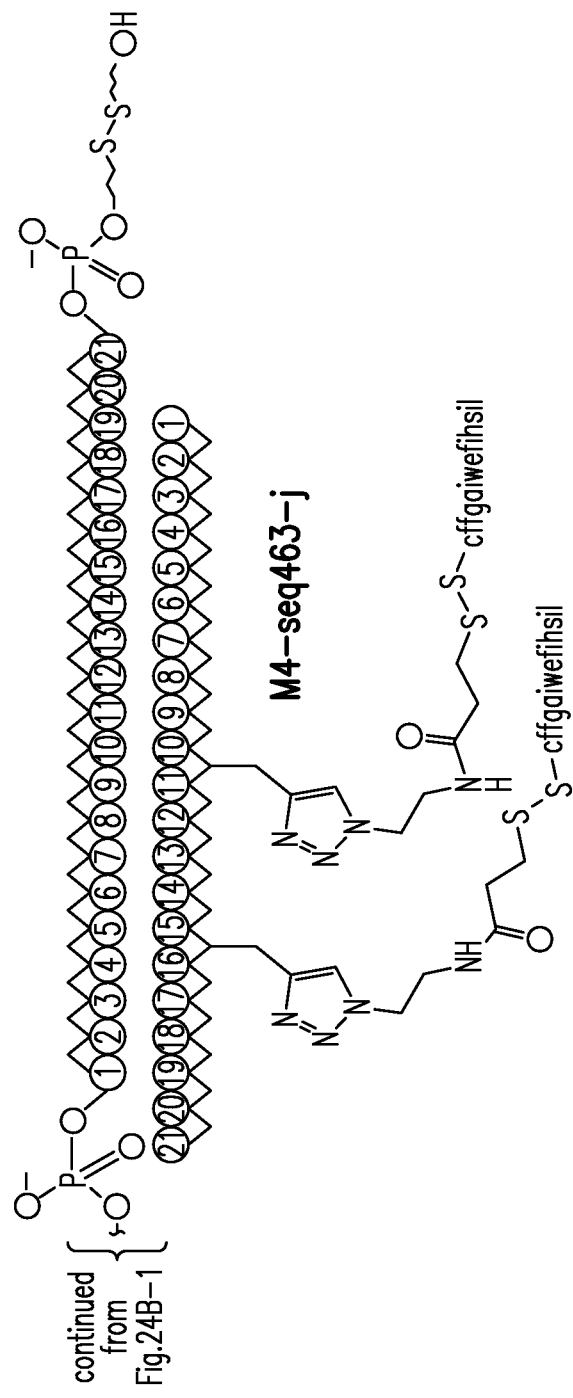

Scheme 10 as shown in FIG. 11A to FIG. 11 D was used to prepare D1, D3 and D4.

Synthesis of D1 (Ex. 31)

To a solution of NHS ester (100.0 mg, 0.320 mmol) in 0.5 mL anhydrous DCE were added azido amine (253.0 mg, 0.480 mmol) in 0.5 mL anhydrous DCE and 1.5 eq. triethylamine. The resulting solution was stirred for 1 h at room temperature, and the reaction mixture was loaded on a silica column, eluding with MeOH/DCM=0/100 to 10/90 over 25 min. The collected fraction was subject to LC-MS analysis and the result indicated>95% purity.

Synthesis of D3 (Ex. 32)

Oligonucleotide D2 (10 mg, 1.3 µmol) and azide linker D1 (5.6 mg, 7.8 µmol) were dissolved in degassed 3:1 DMA/water (1000 µL) in an Eppendorf tube, then a solution of copper(I) bromide-dimethyl sulfide (0.05 mg, 0.26 µmol) in degassed MeCN (100 µL) was added to the reaction mixture. After 60 min at 40° C., D2 was completely consumed monitored by LC-MS. The reaction mixture was diluted with 0.4 M EDTA (5 mL) and stirred for additional 15 min, then dialyzed against water using a Millipore 3K membrane and purified by RP HPLC (5%-60% A in B, A: 100 mM TEAA in MeCN, B: 100 mM TEAA in water). The product fractions were dialyzed against water and lyophilized to afford D3 as a white powder.

Synthesis of D4 (Ex. 33)

TetraGalNAc A10 (5.7 mg, 3.5 µmol), HATU (2.0 mg, 5.2 µmol), N,N-diisopropylethylamine (1.8 mg, 14 µmol) were dissolved in DMSO (100 µL). After 10 min, the activated ester was added to oligonucleotide D3 (6.4 mg, 0.70 µmol) in DMF (350 µL) and water (50 µL). The resulting reaction mixture was stirred for 15 min and quenched by addition of water, then purified by RP HPLC (5%-60% A in B, A: 100 mM TEAA in MeCN, B: 100 mM TEAA in water). The product fractions were dialyzed against water and lyophilized to afford R3 as a whiter powder.

Examples 34-35

Preparation of D5-Seq32 and D7-Seq32

Scheme 11 as shown in FIG. 12A-1 to FIG. 12B-2 was used to prepare D5-seq32 and D7-seq32.

Synthesis of D5-Seq32 (Ex. 34)

Oligonucleotide D4 (6.5 mg, 0.60 µmol) in 200 µL formamide/pH=6.8 Tris buffer=3/1 was treated with peptide seq32 (9.8 mg, 2.4 µmol) in 200 µL of the same buffer and the resulting reaction mixture was stirred for 1 h. The reaction was diluted by addition of formamide 2.5 mL and purified by strong anion exchange chromatography on a Sepax Proteomix SAX NP10, 21.2×50 mm column (2%-30% B in A over 8 min, A: 60:40 trifluoroethanol:water, 40 mM triethylamine, B: 60:40 trifluoroethanol:water, 40 mM triethylamine, 1 M guanidine-HCl, 20 mL/min) to afford D5-seq32 as a white powder.

Synthesis of D7-Seq32 (Ex. 35)

Oligonucleotide D5-seq32 (5.7 mg, 0.304 µmol) and the corresponding antisense strand D6 (2.0 mg, 0.29 µmol) were mixed in RNase free water for 1 h. The reaction mixture was lyophilized and the product D7-seq32-d was submitted for in vivo evaluation.

Synthesis of Additional D7-Peptide Conjugates

Additional conjugates of D7 and peptide sequence were prepared in a manner analogous to that used for D7-seq32.

Section E. Synthesis of Hybrid of Lipid and Peptide Conjugates

Examples 36-42

Scheme 12 is shown in FIG. 13A to FIG. 13H-2.

Synthesis of E2 (Ex. 36)

Oligonucleotide E1 (300 mg, 39 µmol) and the PEG9 azide linker (58.5 mg, 78 µmol) were dissolved in degassed 3:1 DMA/water (10 mL) in a glass vial, then a solution of copper(I) bromide-dimethyl sulfide (20.06 mg, 98 µmol) in degassed DMSO (699 µL) was added to the reaction mixture. After 40 min at 45° C., E1 was completely consumed monitored by LC-MS. The reaction mixture was diluted with 0.4 M EDTA (20 mL) and stirred for additional 15 min, then dialyzed against water using a Millipore 3K membrane and lyophilized to afford E2 as a white powder.

Synthesis of E3 (Ex. 37)

TetraGalNAc A10 (237 mg, 145 µmol), HATU (55.2 mg, 145 µmol), N,N-diisopropylethylamine (94 mg, 726 µmol) were dissolved in DMSO (700 µL). After 10 min, the activated ester was added to oligonucleotide E2 (306 mg, 36 µmol) in DMA (7.5 mL) and water (2.5 mL). The resulting reaction mixture was stirred for 15 min and quenched by addition of water, then purified by RP HPLC (5%-60% A in B, A: 100 mM TEAA in MeCN, B: 100 mM TEAA in water). The product fractions were dialyzed against water and lyophilized to afford E3 as a whiter powder.

Synthesis of E4 (Ex. 38)

To a solution of E3 (246 mg, 24 µmol, 1 eq.) in water (8000 µL) was added TCEP-HCl (70 mg, 244 µmol, 10 eq.). The reaction mixture was mixed until TCEP-HCl fully dissolved. The solution was left at room temperature for 2 hours. The solution was centrifugal dialyzed two times against water over a 3K membrane to afford crude E4 which was directly used in the next step.

Synthesis of E5 (Ex. 39)

To a solution of E4 (244 mg, 24 µmol) in water (12 mL) was added N-(2-aminoethyl)maleimide trifluoroacetate salt (62.2 mg, 0.245 mmol, 10 eq.) dissolved in MeCN (0.5 mL). The solution was left at room temperature for 1 hour. LCMS indicated complete conversion. The solution was centrifugal dialyzed twice against water over a 3K membrane and lyophilized to afford E5 as a white powder.

Synthesis of E6 (Ex. 40)

E5 (40 mg, 3.95 µmol, 1 eq.) was dissolved in 4:1 DMA/water (500 µL). DIPEA (10.2 mg, 79 µmol, 20 eq.) was added to the above solution. Cholesterol chloroformate (18 mg, 40 µmol, 10 eq.) was dissolved in THF (500 µL). The two solutions were mixed together, and the reaction mixture was left at room temperature for 1 hour. LCMS indicated that the reaction was done. The reaction mixture was purified by RP HPLC (5%-95% B in A, A: 100 mM TEAA in water, B: 100 mM TEAA in MeCN). The product fractions were dialyzed against water and lyophilized to afford E6 as a whiter powder.

Synthesis of E7 (Ex. 41)

To a solution of E6 (24.5 mg, 2.3 µmol, 1 eq.) in water (1000 µL) was added piperidine in DMF (200 µL, 20% by volume, 200 eq.). The reaction mixture was left at room temperature for 1 hour. LCMS indicated that the reaction was done. The reaction mixture was filtered (0.2 uM), dialyzed against water, and lyophilized to give E7 as a whiter powder.

Synthesis of E8 (Ex. 42)

E7 (16 mg, 1.55 µmol, 1 eq.) was dissolved in freshly prepared aqueous sodium bicarbonate (0.1M, 400 µL). SPDP (4.85 mg, 0.016 mmol, 10 eq.) was dissolved in acetonitrile (400 uL). The two solutions were mixed together, and the reaction mixture was left at room temperature for 1 hour. The reaction mixture was purified by RP HPLC (5%-95% B in A, A: 100 mM TEAA in water, B: 100 mM TEAA in MeCN). The product fractions were dialyzed against water and lyophilized to afford E8 as a whiter powder.

Examples 43-44

Preparation of E8-Seq 137 and E9-Seq 137

Scheme 13 is shown in FIG. 14A-1 to FIG. 14B-2.

Synthesis of E9-Seq137 (Ex. 43)

Oligonucleotide E8 (3.0 mg, 0.286 µmol) in 100 µL of 2 M Thiourea/20 mM MES in Formamide pH 6.5 was treated with peptide seq 137 (2.33 mg, 0.572 µmol) in 100 µL of the same buffer and the resulting reaction mixture was left at RT for 30 min. The reaction was diluted by addition of formamide 1 mL and purified by strong anion exchange chromatography on a Propac SAX 22×250 mm column (5%-45% B in A over 15 min, A: 60:40 trifluoroethanol:water, 20 mM triethylamine, B: 60:40 trifluoroethanol:water, 20 mM triethylamine, 1 M guanidine-HCl, 20 mL/min) to afford E9-seq-137 as a white powder.

Synthesis of E10-Seq137-e (Ex. 44)

Passenger strand E9-seq137 (1.30 mg, 0.077 µmol) and the corresponding guide strand B7 (0.561 mg, 0.077 µmol) were mixed in RNase free water and heated to 90° C. for 1 min, then left at RT for 10 min. The duplex was lyophilized and the resulting product isolated as an amorphous white powder.

Synthesis of Additional E10-Peptide Conjugates

Additional conjugates of E10 and peptide sequence were prepared in a manner analogous to that used for E10-Seq137-e.

Section F. Preparation of 3, 13, 18 Tripeptide Conjugates

Examples 45-49

Scheme 14 is shown in FIG. 15A to FIG. 15E-2.

Synthesis of Compound F2 (Ex. 45)

Compound A10 (210 mg, 0.129 mmol) was dissolved in dry N-methyl-2-pyrrolidinone (3 ml). HATU (48.9 mg, 0.129 mmol) and dry diisopropylethylamine (0.046 ml, 0.257 mmol) were added, and the mixture was sonicated until the solid was fully dissolved. The reaction was left at RT for 5 min. In a separate vial, compound F1 (500 mg, 0.0646 mmol) was dissolved in water (2 ml) and N-methyl-2-pyrrolidinone (5 ml). The A10 solution was added to the F1 solution, and the reaction was left at RT for 5 min. The reaction mixture was loaded on to an HPLC fitted with an Agilent PL-SAX 8 um 50×150 mm column heated to 60° C. The product was gradient eluted by starting at 100% solvent A (4:1 $H_2O$:ethanol, 20 mM triethylammonium acetate pH 7.0) and increasing to 80% solvent B (4:1 $H_2O$:ethanol, 20 mM triethylammonium acetate pH 7.0, 1M guanidinium hydrochloride) over 30 min at 100 ml/min. The fractions were combined, and the ethanol content was reduced to 5% by diluting with water. The solution was pump loaded onto a Waters XBridge Sum 50×50 mm column at 50 ml/min, and the product was washed with water at 100 ml/min for 5 min. The desalted product was eluted by reversing the column and flowing 2:3 $H_2O$:acetonitrile at 50 ml/min through the column. The fraction was freeze dried to afford F2 as a white amorphous solid. Expected mass: 9363.6, found mass: 9363.5.

Synthesis of Compound F3 (Ex. 46)

F2 (500 mg, 0.0534 mmol) and azido-peg9-amine (253 mg, 0.481 mmol) were dissolved in 2,2,2-trifluoroethanol (5 ml) and water (5 ml). Nitrogen was bubbled through the solution for 1 min. In a separate vial, copper(I) bromide dimethyl sulfide (43.9 mg, 0.214 mmol) was dissolved in acetonitrile (2.5 ml). Nitrogen was bubbled through the solution for 1 min. The two solutions were mixed together, and nitrogen was bubbled through the reaction mixture for 1 min. The vial was sealed and left at RT for 1 hour. The reaction mixture was quenched with EDTA solution (0.5M, pH 8.0, 1 mL) and loaded onto an HPLC fitted with a Waters XBridge Sum 50×250 mm column. The product was gradient eluted by starting at 100% solvent A ($H_2O$, 0.1M triethylammonium acetate pH 7.0) and increasing to 40% solvent B (acetonitrile) at 100 ml/min over 30 minutes. The fractions were combined, and the acetonitrile content was reduced to 5% by diluting with water. The solution was pump loaded onto a Waters XBridge Sum 50×50 mm column at 50 ml/min, and the product was washed with water at 100 ml/min for 5 min. The desalted product was eluted by reversing the column and flowing 2:3 $H_2O$:acetonitrile at 50 ml/min through the column. The fraction was freeze dried to afford F3 as a white amorphous solid. Expected mass: 10943.5, found mass: 10943.2.

Synthesis of Compound F4 (Ex. 47)

F3 (467 mg, 0.0427 mmol) was dissolved in sodium bicarbonate solution (0.1M, 4.5 mL). NHS-SPDP (120 mg, 0.384 mmol) was dissolved in acetonitrile (1 mL). The solutions were mixed together, and the reaction was left at RT for 15 min. The reaction mixture was loaded onto an HPLC fitted with a Waters XBridge Sum 50×250 mm column. The product was gradient eluted by starting at 100% solvent A ($H_2O$, 0.1M triethylammonium acetate pH 7.0) and increasing to 40% solvent B (acetonitrile) at 100 ml/min over 30 min. The fractions were combined, and the acetonitrile content was reduced to 5% by diluting with water. The solution was pump loaded onto a Waters XBridge Sum 50×50 mm column at 50 ml/min, and the product was washed with water at 100 ml/min for 5 min. The desalted product was eluted by reversing the column and flowing 2:3 $H_2O$:acetonitrile at 50 ml/min through the column. The fraction was freeze dried to afford F4 as a white amorphous solid. Expected mass: 11535.3, found mass: 11535.1.

Synthesis of F5-Seq 463 (Ex. 48)

Peptide Seq. 612 (8.75 mg, 0.00520 mmol) was dissolved in DMSO (1 mL) containing 20 mM acetic acid. In a separate vial, F4 (10 mg, 0.000867 mmol) was dissolved in DMSO (1 ml) containing 20 mM acetic acid. The two solutions were mixed together and left at RT for 1 hour. The reaction was quenched with N-methylmaleimide (5.78 mg, 0.0520 mmol) and loaded onto an HPLC fitted with an Agilent PL-SAX 10 um 25×50 mm column. The product was gradient eluted by starting at 100% solvent A (2:3 $H_2O$:2,2,2-trifluoroethanol, 20 mM triethylamine) and increasing to 70% solvent B (2:3 $H_2O$:2,2,2-trifluoroethanol, 20 mM triethylamine, 0.5M guanidinium hydrochloride) at 30 ml/min over 20 min. The fractions were combined and loaded onto an HPLC fitted with a Waters XBridge Sum 19×250 mm column. The product was gradient eluted by starting at 85% solvent A (H$_2$O, 0.1M hexylammonium acetate pH 7.0) and increasing to 65% solvent B (tetrahydrofuran) at 20 ml/min over 30 min. The fractions were combined, and the tetrahydrofuran content was reduced to less than 5% under vacuum. The solution was centrifugal dialyzed over a 10 k membrane once against water, once against 4:1 H$_2$O:ethanol containing 0.1M sodium chloride, and two more times against water. The concentrate was freeze dried to afford F5-Seq 463 as a white amorphous solid. Expected mass: 16247.8, found mass: 16247.9.

Example 49

Scheme 15 is shown in FIG. 16A-1 to FIG. 16B-2.

Synthesis of F6 Seq 463-f (Ex. 49)

F5-Seq 463 (7.75 mg, 0.000477 mmol) and Guide B7 (3.27 mg, 0.000477 mmol) were dissolved in H$_2$O (0.5 mL). The solution was left at RT for 1 hour and then freeze dried to afford the duplex of F6 Seq 463-f as a white amorphous solid (11 mg, quantitative). Expected mass of passenger strand: 16247.8, found mass: 16247.9. Expected mass of guide strand: 6852.5, found mass: 6852.7.

Synthesis of Additional F10-Peptide Conjugates an Duplexes

Additional conjugates of F10 and peptide sequences and their duplexes were prepared in a manner analogous to that used for F6-Seq 463-f Section G. Preparation of 3,8,13,18 Tetrapeptides Examples 50-53

Scheme 16 is shown in FIG. 17A-1 to FIG. 17D-2.

Synthesis of G2 (Ex. 50)

A10 (210 mg, 0.129 mmol) was dissolved in dry N-methyl-2-pyrrolidinone (3 ml). HATU (48.9 mg, 0.129 mmol) and dry diisopropylethylamine (0.046 ml, 0.257 mmol) were added, and the mixture was sonicated until the solid was fully dissolved. The reaction was left at RT for 5 min. In a separate vial, G1 (500 mg, 0.0643 mmol) was dissolved in water (2 ml) and N-methyl-2-pyrrolidinone (5 ml). The A10 solution was added to the G1 solution, and the reaction was left at RT for 5 min. The reaction mixture was loaded on to an HPLC fitted with an Agilent PL-SAX 8 um 50×150 mm column heated to 60° C. The product was gradient eluted by starting at 100% solvent A (4:1 H$_2$O: ethanol, 20 mM triethylammonium acetate pH 7.0) and increasing to 80% solvent B (4:1 H$_2$O:ethanol, 20 mM triethylammonium acetate pH 7.0, 1M guanidinium hydrochloride) over 30 minutes at 100 ml/min. The fractions were combined, and the ethanol content was reduced to 5% by diluting with water. The solution was pump loaded onto a Waters XBridge Sum 50×50 mm column at 50 ml/min, and the product was washed with water at 100 ml/min for 5 min. The desalted product was eluted by reversing the column and flowing 2:3 H$_2$O:acetonitrile at 50 ml/min through the column. The fraction was freeze dried to afford the G2 as a white amorphous solid. Expected mass: 9399.7, found mass: 9399.5.

Synthesis of G3 (Ex. 51)

G2 (483 mg, 0.0514 mmol) and azido-peg9-amine (324 mg, 0.617 mmol) were dissolved in 2,2,2-trifluoroethanol (5 ml) and water (5 ml). Nitrogen was bubbled through the solution for 1 min. In a separate vial, copper(I) bromide dimethyl sulfide (50 mg, 0.244 mmol) was dissolved in acetonitrile (2.5 ml). Nitrogen was bubbled through the solution for 1 min. The two solutions were mixed together, and nitrogen was bubbled through the reaction mixture for 1 min. The vial was sealed and left at RT for 1 hour. The reaction mixture was quenched with EDTA solution (0.5M, pH 8.0, 1 mL) and loaded onto an HPLC fitted with a Waters XBridge Sum 50×250 mm column. The product was gradient eluted by starting at 100% solvent A (H$_2$O, 0.1M triethylammonium acetate pH 7.0) and increasing to 40% solvent B (acetonitrile) at 100 ml/min over 30 min. The fractions were combined, and the acetonitrile content was reduced to 5% by diluting with water. The solution was pump loaded onto a Waters XBridge Sum 50×50 mm column at 50 ml/min, and the product was washed with water at 100 ml/min for 5 min. The desalted product was eluted by reversing the column and flowing 2:3 H$_2$O: acetonitrile at 50 ml/min through the column. The fraction was freeze dried to afford G3 as a white amorphous solid. Expected mass: 11506.2, found mass: 11506.0.

Synthesis of G4 (Ex. 52)

G3 (455 mg, 0.0396 mmol) was dissolved in sodium bicarbonate solution (0.1M, 5 mL). NHS-SPDP (160 mg, 0.512 mmol) was dissolved in acetonitrile (1.5 mL). The solutions were mixed together, and the reaction was left at RT for 15 min. The reaction mixture was loaded onto an HPLC fitted with a Waters XBridge Sum 50×250 mm column. The product was gradient eluted by starting at 100% solvent A (H$_2$O, 0.1M triethylammonium acetate pH 7.0) and increasing to 40% solvent B (acetonitrile) at 100 ml/min over 30 min. The fractions were combined, and the acetonitrile content was reduced to 5% by diluting with water. The solution was pump loaded onto a Waters XBridge Sum 50×50 mm column at 50 ml/min, and the product was washed with water at 100 ml/min for 5 min. The desalted product was eluted by reversing the column and flowing 2:3 H$_2$O:acetonitrile at 50 ml/min through the column. The fraction was freeze dried to afford G4 as a white amorphous solid. Expected mass: 12295.3, found mass: 12295.1.

Synthesis of G5-Seq 489 (Ex. 53)

Peptide SEQ ID NO: 489 (CIFGAIAGFIKNIWEGLI all (D)) (13.6 mg, 0.00694 mmol) was dissolved in DMSO (1 mL) containing 20 mM acetic acid. In a separate vial, G4 (10 mg, 0.000867 mmol) was dissolved in DMSO (1 ml) containing 20 mM acetic acid. The two solutions were mixed together and left at RT for 1 hour. The reaction was quenched with N-methylmaleimide (7.71 mg, 0.0694 mmol) and loaded onto an HPLC fitted with an Agilent PL-SAX 10 um 25×50 mm column. The product was gradient eluted by starting at 100% solvent A (2:3 $H_2O$:2,2,2-trifluoroethanol, 20 mM triethylamine) and increasing to 70% solvent B (2:3 $H_2O$:2,2,2-trifluoroethanol, 20 mM triethylamine, 0.5M guanidinium hydrochloride) at 30 ml/min over 20 min. The fractions were combined and loaded onto an HPLC fitted with a Waters XBridge Sum 19×250 mm column. The product was gradient eluted by starting at 85% solvent A ($H_2O$, 0.1M hexylammonium acetate pH 7.0) and increasing to 65% solvent B (tetrahydrofuran) at 20 ml/min over 30 min. The fractions were combined, and the tetrahydrofuran content was reduced to less than 5% under vacuum. The solution was centrifugal dialyzed over a 10 k membrane once against water, once against 4:1 $H_2O$:ethanol containing 0.1M sodium chloride, and two more times against water. The concentrate was freeze dried to afford G5-Seq 489 as a white amorphous solid. Expected mass: 19708.1, found mass: 19708.0.

Example 54

Scheme 17 is shown in FIG. 18A-1 to FIG. 18B-2.

Synthesis of G6-Seq 489-g (Ex. 54)

G5-Seq 489 (8.5 mg, 0.000434 mmol) and B7 (2.98 mg, 0.000434 mmol) were dissolved in $H_2O$ (0.5 mL). The solution was left at RT for 1 hour and then freeze dried to afford the duplex G6-Seq 489-g as a white amorphous solid. Expected mass of passenger strand: 19708.1, found mass: 19708.3. Expected mass of guide strand: 6852.5, found mass: 6852.6.

Synthesis of Additional G6-Peptide Conjugates and Duplexes

Additional conjugates of G6 and peptide sequences and their duplexes were prepared in a manner analogous to that used for G6-Seq 489-g.

Section H. Preparation of 3,8,13,18 tetrapeptide

Examples 55-58

Scheme 18 below was used to prepare H1 to H5.

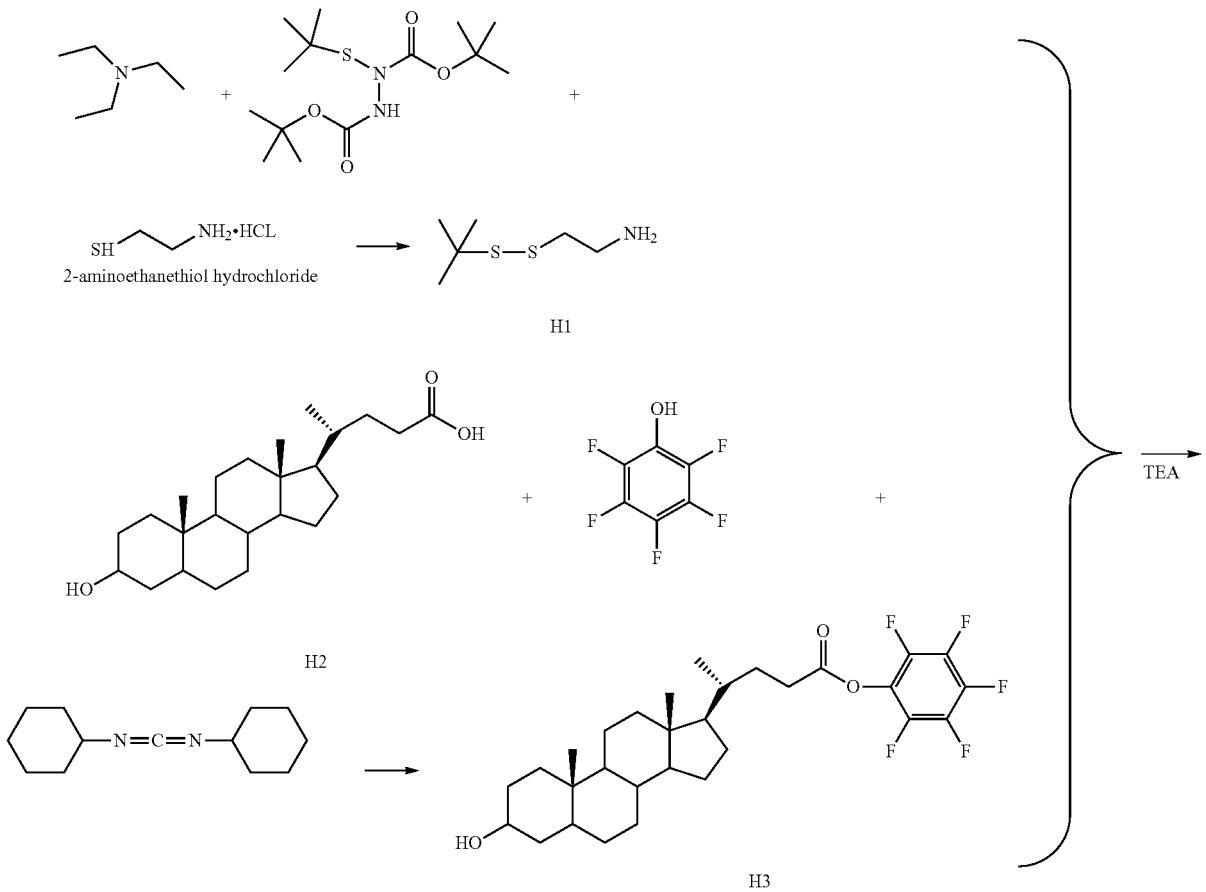

-continued

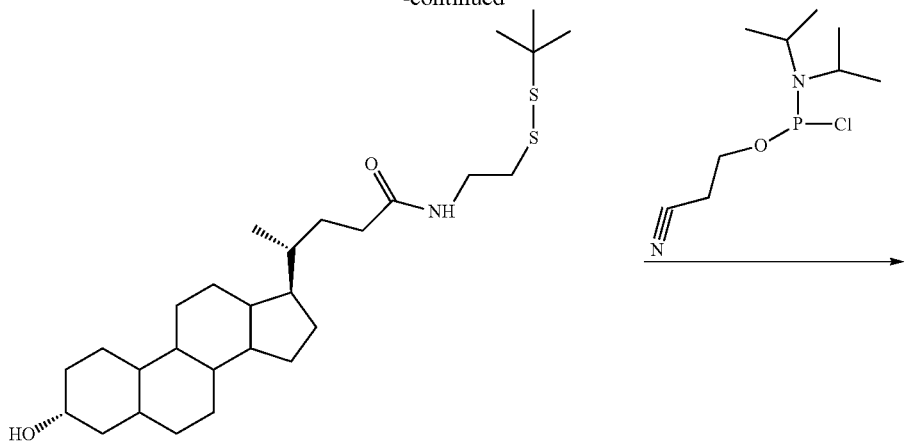

H4

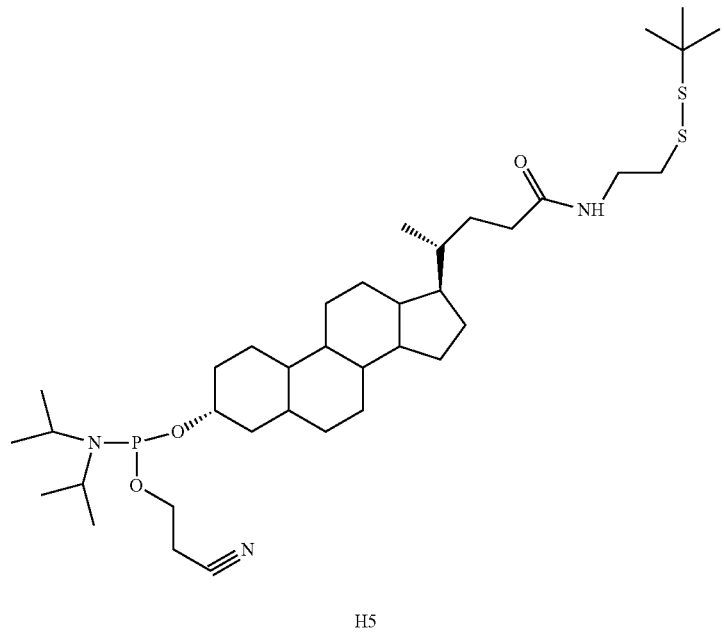 [SMILES: CC(C)N(C(C)C)P(OCCC#N)O[C@@H]1CCC2C(CCC3C2CCC2C3CC[C@@H]2[C@H](C)CCC(=O)NCCSSC(C)(C)C)C1 ; "H5"]

H5

Synthesis of H1 (Ex. 55)

Into a 500-mL round-bottom flask purged and maintained with an inert atmosphere of nitrogen was placed a solution of di-tert-butyl 1-(tert-butylthio)hydrazine-1,2-dicarboxylate (15 g, 46.8 mmol, 2.00 equiv) in N,N-dimethylformamide (30 mL). A solution of 2-aminoethanethiol hydrochloride (2.66 g, 23.4 mmol, 1 eqiv) in N, N-dimethylformamide (80 ml) was added slowly into the round-bottom flask. This was followed by the addition of triethylamine (2.36 g, 23.4 mmol, 1 equiv). After stirring at RT overnight, a white solid was precipitating. Dry N, N-dimethylformamide (100 ml) was added to obtain a nearly clear solution. Triethylamine was added until a white solid was precipitating again. The reaction mixture was stirred at RT for 8 hours. The solution was filtered and evaporated under reduced pressure. Diethyl ether (200 ml) was added to the residue and filtered. The white solid was collected and dried in dessicator. Afterward, this white solid was dissolved five times in diethyl ether (5×10 ml), stirred for several minutes and filtered. The desired product was obtained as a white solid. $^1$HNMR (CDCl$_3$, 500 MHz, ppm): 1.36 (s, 9H), 3.07 (t, 2H), 3.4 (t, 2H), 8.3 (s, 2H).

Synthesis of H3 (Ex. 56)

Lithocholic acid (H2) (7 gm, 18.59 mmol, 1 equiv) was dissolved in dry dicholormethane (200 ml) and then cooled to 0° C. Following this N, N-dicyclohexylcarbodiimide (4.6 g, 22.31 mmol, 1.2 equiv) was added to the solution. After stirring for 30 min at 0° C., pentafluorophenol (3.76 gm, 20.45 mmol, 1.1 equiv) in dichloromethane (13 ml) was added. Stirring was then continued at RT under argon for an additional 20 h. The precipitated N, N-dicyclohexylurea was filtered off and washed with cold dichloromethane. Combined filterates were then evaporated under reduced pressure. The oily residue obtained was then diluted with dichloromethane (50 ml) and washed with sat. aq. NaCl (60 ml) and water (80 ml). The organic phase was dried over Na$_2$SO$_4$, filtered and evaporated to dryness. The dried compound was purified using column chromatography (elution with CH$_2$Cl$_2$/CH$_3$OH, 100/0-97/3). MS (m/z); 566 [M+Na]$^+$

Synthesis of H4 (Ex. 57)

Compound H3 (4.5 gm, 8.29 mmol, 1 equiv) was dissolved in dry dichloromethane (15 ml) and then cooled to 0° C. A cold mixture of 2-(tert-butyldisulfanyl)ethanamine (H1) (2.057 gm, 12.44 mmol, 1.5 equiv) and triethylamine (2.56 gm, 2.52 mmol, 3 equiv) in dichloromethane (7 ml) was added to the resulting solution. The reaction mixture was stirred at RT for 2 h. TLC confirmed the formation of product. The reaction mixture was washed with sat. aq. NaCl (20 ml×2) and water (20 ml×2). The organic phase was dried over $Na_2SO_4$, filtered and dried over vacuum. The crude product was purified via silica gel column chromatography (elution with $CH_2Cl_2/CH_3OH$, 100/0-95/5) yielding pure compound H4. MS (m/z); 524.35, $[M+1]^+$

Synthesis of H5 (Ex. 58)

H4 (3 gm, 5.73 mmol, 1 equiv) was dissolved in dry dichloromethane (15 ml) and triethylamine was added (0.869 g, 8.59 mmol, 1.5 equiv). The reaction mixture was cooled to 0° C. 2-Cyanoethyl-N, N-diisopropylaminochlorophosphite (2.71 gm, 11.45 mmol, 2 equiv) in dry dichloromethane (10 ml) was added dropwise to the reaction mixture. The resulting solution was stirred for 1 h. TLC confirmed the formation of product. The reaction mixture was evaporated and purified on silica gel column (elution with hexanes/ethylacetate/triethylamine, 100/0/1.5 to 60/40/1.5). MS (m/z); 724.46 $[M+1]^+$ $^{31}$P NMR ($CDCl_3$, 500 MHz, ppm); 146.5

Examples 59-66

Scheme 19 as shown in FIG. 19A to FIG. 19I-2 was used to prepare Ex. 59 to Ex. 66.

Synthesis of H6 (Ex. 59)

See synthesis of B2 for reaction procedure. Expected mass: 9609.071, found mass: 9605.

Synthesis of H7 (Ex. 60)

To a solution of H6 (15 mg, 1.56 umol, 1 eq) in water (1400 ul) was added TCEP-HCl (26.8 mg, 0.094 mmol, 60 eq). The reaction mixture was mixed until TCEP-HCl fully dissolved. The solution was left at RT overnight. The solution was centrifugal dialyzed two times against water over 3K membrane. Expected mass: 9520, found mass: 9517.

Synthesis of H8 (Ex. 61)

See synthesis of B9 for reaction procedure. Expected mass: 9630, found mass: 9627.

Synthesis of H9-Seq32 (Ex. 62)

See the synthesis of B10-seq32 for reaction procedure. Expected mass: 13597, found mass: 13598.

Synthesis of H7-Seq32-h (Ex. 63)

See the synthesis of B11-seq32 for reaction procedure.

Synthesis of H8 (Ex. 64)

See the synthesis of C13 for reaction procedure. Expected mass: 9741.

Synthesis of H9-Seq32 (Ex. 65)

See the synthesis of C14 for reaction procedure. Expected mass: 13819, found mass: 13820.

Synthesis of H10-Seq32-h (Ex. 66)

See the synthesis of C15-Seq32 for reaction procedure.

Additional Synthesis of H7 and H10 Peptide Conjugates

Additional conjugates of H7 and H10 and peptide sequences and their duplexes were prepared in a manner analogous to that used for H7-Seq32-h and H10-Seq32-h.

Section I. Preparation of 3,13,18 Trienzymatic Cleavble Linker Peptide Conjugates

Examples 67-73

Scheme 20 is shown in FIG. 20A-1 to FIG. 20E-2.

Synthesis of I3 (Ex. 67)

I1 (160 mg, 0.209 mmol) and I2 (48.8 mg, 0.219 mmol) were dissolved in DMA (1 mL) and were treated with N-methylmorpholine (46 µL, 0.417 mmol). The reaction was stirred at RT for 6 hours, then purified by RP-HPLC (95:5-20:80% A:B linear gradient (A=0.1% aqueous TFA; B=0.1% TFA in acetonitrile) Waters C18 xbridge Column 19×250 mm). Fractions containing 13 were extracted with 2:1 DCM:MeOH, dried over $Na_2SO_4$, filtered, and concentrated in vacuo to give the product. Measured mass=814.3

Synthesis of I4 (Ex. 68)

I3 (88 mg, 0.108 mmol) was dissolved in DMA (1 mL) and was treated with piperidine (200 µL, 2.02 mmol) and stirred at 10° C. for 10 min. TFA (156 µL, 2.02 mmol) was added to quench the reaction. The reaction mixture was purified by RP-HPLC (95:5-60:40% A:B linear gradient (A=0.1% aqueous TFA; B=0.1% TFA in acetonitrile) Waters C18 xbridge Column 30×250 mm). Fractions containing 14 were lyophilized to give the product. Measured mass=592.3.

Synthesis of I5 (Ex. 69)

I4 (912 mg, 1.324 mmol) was dissolved in DMSO (7.7 mL) and treated with L1 (1.0 g, 1.40 mmol) and DIEA (463 µL, 2.65 mmol). The reaction mixture was stirred for 15 min and was purified by RP-HPLC (100:0-0:100% A:B linear gradient (A=0.1% aqueous TFA; B=0.1% TFA in acetonitrile) Waters C18 xbridge column. Fractions containing I5 were lyophilized to give the product. Measured mass=609.5 [M+2]

Synthesis of I7 (Ex. 70)

I6 (500 mg, 0.065 mmol) and I5 (236 mg, 0.194 mmol) were dissolved in a pH 5.5 MES buffer (51.6 ml, 500 mM) and acetonitrile (12.91 ml). The solution was degassed with nitrogen for 10 min, after which it was treated with CuBr.SMe$_2$ (133 mg, 0.646 mmol) and degassed for an additional five minutes with nitrogen. The reaction mixture was sonicated and stirred for 30 min, then purified by RP-HPLC (95:5-5:95% A:B linear gradient (A=100 mM aqueous TEAA; B=100 mM TEAA in acetonitrile) Waters Phenyl xbridge Column). Fractions containing product were dialyzed twice against 0.32M EDTA pH 6.5 over a 3K membrane, then three times against water. The concentrate was then dialyzed twice against 200 mM TEAA and then three times against water. The concentrate was lyophilized to give the product as an amorphous white solid. Measured mass=11400

Synthesis of I8 (Ex. 71)

I7 (287 mg, 0.025 mmol) was suspended in water (100 uL) and diluted with NMP (2.0 mL), which produced a homogeneous solution upon standing. HATU (13 mg, 0.035 mmol) was dissolved in NMP (200 uL) and was added to A10 (62 mg, 0.038 mmol). The reaction mixture was diluted with NMP (200 uL) and was then treated with DIEA (13 uL, 0.076 mmol). The HATU reaction mixture was then added to the RNA solution in one portion and aged for 10 min. Reaction was diluted with DI water and purified by RP-HPLC (95:5-5:95% A:B linear gradient (A=100 mM aqueous TEAA; B=100 mM TEAA in acetonitrile) Waters Phenyl xbridge Column). Fractions containing 18 were dialyzed three times against water over a 3K membrane. The concentrate was lyophilized to give the product as an amorphous white solid. Measured mass=13027.

Synthesis of I9-Seq 1681 (Ex. 72)

I8 (20 mg, 1.537 μmol) was dissolved in TFE modified with 50 mM AcOH (2 mL). In a separate vial, Seq ID 1681 (8.63 mg, 6.15 umol) was suspended in 8M Gn.HCl (400 uL) and was diluted with 50 mM AcOH in TFE (2 mL) to form a slightly cloudy suspension, then added to the RNA solution. After 10 min, more Seq ID 1681 (8.63 mg, 1.54 umol) was added and the reaction was aged 30 min, after which AEX indicated near-complete conversion to desired product. Reaction was quenched with N-methylmaleimide (6.83 mg, 61.5 μmol) and was purified by AEX (0-40% 1M Gn.HCl in 1:1 water:TFE with 40 mM TEAA pH 7.5, Proteomix NP10 column heated to 60° C.). Material was repurified using 70:30-25:75 gradient of 200 mM HAA pH 7.5:ACN and an Agilent PLRP-S column. Pure fractions were pooled, dialyzed, and lyophilized to give I9-Seq 1681 (6.37 mg, 0.302 μmol, 19.65% yield).

Synthesis of I10-Seq 1681-f (Ex. 73)

I9-seq 1681 (3.02 mg, 0.143 μmol) was dissolved in water (950 μl) and was treated with a solution of B7 (0.980 mg, 0.143 μmol) in water (144 μl). The reaction mixture aged for 15 min and was then lyophilized to give the product as an amorphous white solid. Measured mass=21107.

Additional Synthesis of I10 Peptide Conjugates an Duplexes

Additional conjugates of I10 and peptide sequences and their duplexes were prepared in a manner analogous to that used for I10-seq-1681-f.

Section J. Preparation of Amino Modified C2 Linkers

Examples 74-82

Scheme 21 is shown in FIG. 21A to FIG. 21H-2.

Synthesis of A10B (Ex. 74)

In a test tube equipped with a stir bar, A10 (100 mg, 0.061 mmol) was dissolved in DMSO (611 μl) followed by the addition of Hunig's Base (133 μl, 0.764 mmol) and HATU (76 mg, 0.199 mmol). After 20 min, N-(2-aminoethyl) maleimide trifluoroacetate salt (12.85 mg, 0.092 mmol) dissolved in 400 μL of DMSO was added. After 20 min, the reaction was determined complete and quenched with water (1.5 mL) until yellow color almost dissipated. The reaction was purified by reverse phase chromatography (Gilson 2020, Solvent A) 0.1% TFA in water/Solvent B) 0.1% TFA in ACN, 0-50% gradient for 15 min, 40 mL/min, XBridge Prep C18 5 μm OBD 30×250 mm). The resulting fractions were lyophilized to afford a white solid, A10B. [M+1, expected]=1757.807, [M+1, observed]=1759.0.

Synthesis of J2 (Ex. 75)

See Synthesis of B3 for reaction procedure. J2 [M+1, expected]=7604.750, [M+1, observed]=7600.0.

Synthesis of J3 (Ex. 76)

A10B (10.26 mg, 5.84 μmol) was dissolved in water (700 μL) and added to a 1.8 mL solution (1 water: 1 acetate buffer: 2 formamide) of J2 (29.6 mg, 3.89 μmol). The reaction was shaken at RT for 20 min and then determined complete. The reaction mixture was purified using strong anion exchange chromatography (Gilson PLC 2020, Sepax Proteomix SAX NP10 21.2×50 mm, Buffer A: 3:2 trifluoroethanol:water, 40 mM triethylamine/Buffer B: 3:2 trifluoroethanol:water, 40 mM triethylamine, 1000 mM guanidine-HCl, 1% B hold for 3 minutes, then 5% B-45% B over 12 minutes). The fractions were dialyzed three times against water over a 3K membrane to afford a white solid, J3. [M+1, expected]=9362.556, [M+1, observed]=9359.0.

Synthesis of J4 (Ex. 77)

To an Eppendorf vial, J3 (6.34 mg, 0.678 μmol) was dissolved in water (250 μL). In a separate Eppendorf vial, N-succinimidyl 3-(2-pyridyldithio) propionate (SPDP) (0.831 mg, 2.035 μmol) was dissolved in DMSO (50 μL). The SPDP solution was added to the RNA solution. After 4 hours, the reaction was recharged with additional SPDP (2.77 mg, 6.78 μmol) which was dissolved in 50 μL DMSO. After 24 hr, the reaction was recharged with additional SPDP (2.77 mg, 6.78 μmol) which was dissolved in 50 μL DMSO. After 72 hr, the reaction was diluted to 3 mg/mL with the addition of 390 μL of pH 8.1 sodium bicarbonate. After 2 hr, an additional 3 eq. of SPDP in 50 μL DMSO were added. The reaction mixture was dialyzed three times against water over a 3K membrane and lyophilized to afford a white solid, J4. [M+1, expected]=9543.834, [M+1, observed]=9554.0.

Synthesis of J5-Seq26 (Ex. 78)

See Synthesis of B10-Seq32 for reaction procedure. J5-Seq26—Mass observed: 11413.

Synthesis of J6-Seq26-i (Ex. 79)

See Synthesis of B11-Seq32-b for reaction procedure. J6-Seq26-i—Mass observed: 18265.

Synthesis of J7 (Ex. 80)

To an Eppendorf vial, J3 (5.8 mg, 0.621 μmol) was dissolved in water (250 μL). In a separate Eppendorf vial, Succinimidyl-4-(N-maleimidomethyl)cyclohexane-1-carboxylate (SMCC) (0.727 mg, 1.862 μmol was dissolved in DMSO (50 μL) and the pH was adjusted to pH 5 with the addition of 1 small drop of TFA. The SMCC solution was added to the RNA solution. After several hours, the pH was titrated to pH 7 with the gradual addition of 0.1N NaOH. After 18 hr, 6 eq. of SMCC were dissolved in 50 μL DMSO and added to the reaction mixture. After 4 hr, an additional 3 eq. of SMCC in 50 μL DMSO was added to the reaction. After several hr, 300 μL of pH 8.1 sodium bicarbonate solution was added to the reaction. The reaction was dialyzed three times against water over a 3K membrane and lyophilized to afford a white solid, J7. [M+1, expected]=9543.834, [M+1, observed]=9554.0.

Synthesis of J8-Seq26 (Ex. 81)

See Synthesis of B10-Seq32 for reaction procedure. J8-Seq26—Mass observed: 11545.

Synthesis of J9-Seq26-i (Ex. 82)

See Synthesis of B11-Seq32 for reaction procedure. J9-Seq26-I—Mass expected: 18397.

Additional Synthesis of J6 & J9 Peptide Conjugates

Additional conjugates of J6 and J9 and peptide sequences and their duplexes were prepared in a manner analogous to that used for J6-Seq26, J9-Seq26 and J6-Seq26-i, J9-Seq26-i.

Section K. 3' Bis Peptide Linkers

Examples 83-87

Scheme 22 is shown in FIG. 22A-1 to FIG. 22D-2.

Synthesis of K2 (Ex. 83)

In a 20 mL vial, 3-(tritylthio)propanoic acid (158 mg, 0.454 mmol) was dissolved in DMF (1.514 mL) followed by the addition of HATU (184 mg, 0.484 mmol) and Hunig's base (0.158 mL, 0.908 mmol). The reaction solution turned light yellow in color. After 5 min, K1 (100 mg, 0.151 mmol) was added as a solid and the reaction solution turned transparent orange in color. The reaction was stirred at RT for 15 min and then determined complete.

The reaction was purified by reverse phase chromatography (Gilson 2020, 5-95% ACN/Water with a 0.1% TFA modifier, flow rate: 20 mL/min, gradient time: 22 min, column: XBridge prep OBD 5 μm C18 19×250 nm). The resulting fractions were lyophilized to afford a white solid, K2. [M+1, expected]=877.059, [M+1, observed]=877.4

Synthesis of K3 (Ex. 84)

In an Eppendorf vial, K2 (10.07 mg, 0.011 mmol) was dissolved in formamide (0.5 mL). In a 15 mL Falcon tube, peptide Seq ID 74 (57.92 mg, 0.034 mmol) was dissolved in formamide (1 mL). The peptide/formamide solution was added to the linker/formamide solution and stirred at RT for 20 min.

The reaction was determined complete and the reaction was purified by reverse phase chromatography (Gilson 2020, 5-100% ACN/Water with a 0.1% TFA modifier, flow rate: 20 mL/min, gradient time: 30 minutes, column: XBridge prep OBD 5 μm C18 19×250 nm). The resulting fractions were lyophilized to afford a white solid, K3. [M+3, expected]=1416.03, [M+3, observed]=1415.0

Synthesis of K4 (Ex. 85)

In a 40 mL vial, a solution of TFA (1000 μL), water (96 μL), and triisopropylsilane (96 μL) in a 0.83:0.08:0.08 mixture by volume was combined and added to K3 (47 mg, 0.011 mmol) in a 20 mL vial which was stirred at RT for 10 min. An additional 500 μL of TFA was added and the reaction was stirred for an additional 10 min. The reaction was determined complete, concentrated under reduced pressure, diluted with 3.5 mL of 2M thiourea pH 6.5 in FMD and MES, and purified by reverse phase chromatography (Gilson 2020, 5-80% ACN/Water with a 0.1% TFA modifier, flow rate: 20 mL/min, gradient time: 20 minutes, column: XBridge prep OBD 5 μm C18 19×250 nm). The resulting fractions were lyophilized to afford a white solid, K4. [M+3, expected]=1334.34, [M+3, observed]=1334.4

Synthesis of K5-Seq 74 (Ex. 86)

See Synthesis of B10-Seq32 for reaction procedure. K5-Seq 74—Expected mass: 13178.103.

Synthesis of K6-Seq 74-b (Ex. 87)

See Synthesis of B10-Seq32 for reaction procedure. Observed mass passenger=15907; Observed mass guide=8744; duplex=24651.

Additional Synthesis of K5 Peptide Conjugates and Duplexes

Additional conjugates of K5 and peptide sequences and the corresponding duplexes were prepared in a manner analogous to that used for K5-Seq 74 and K6-Seq 74-b.

Section L. Preparation of Guide Strand Position 2'-10,15 ECL Peptide Conjugates

Examples 88-94

Scheme 23 is shown below, and in FIG. 23A to FIG. 23C-2.

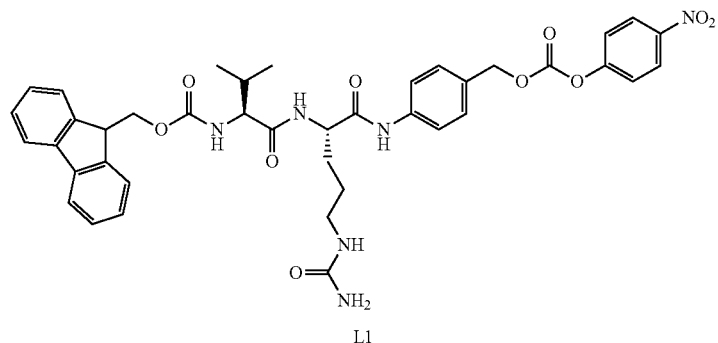
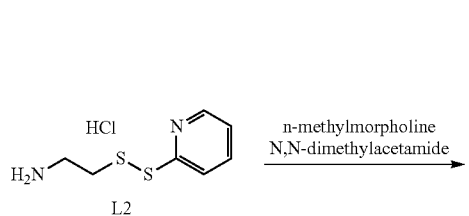
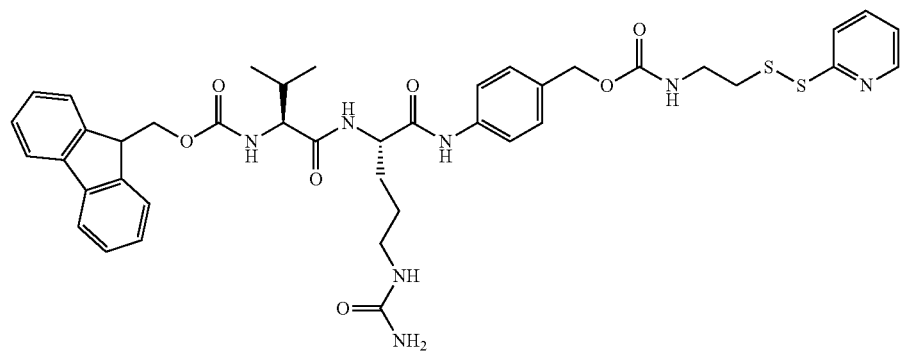
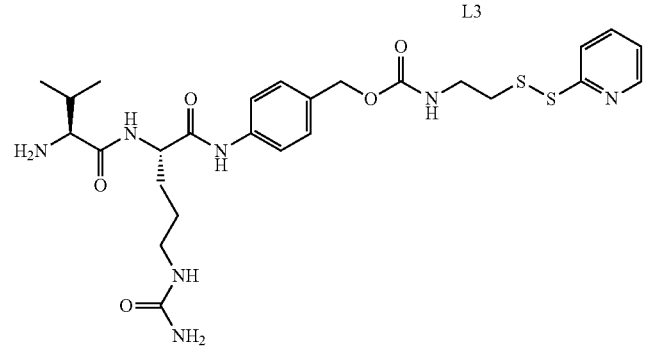
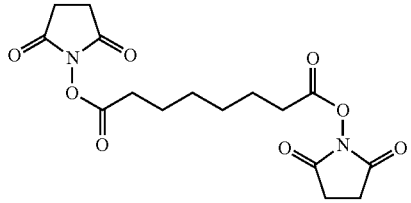
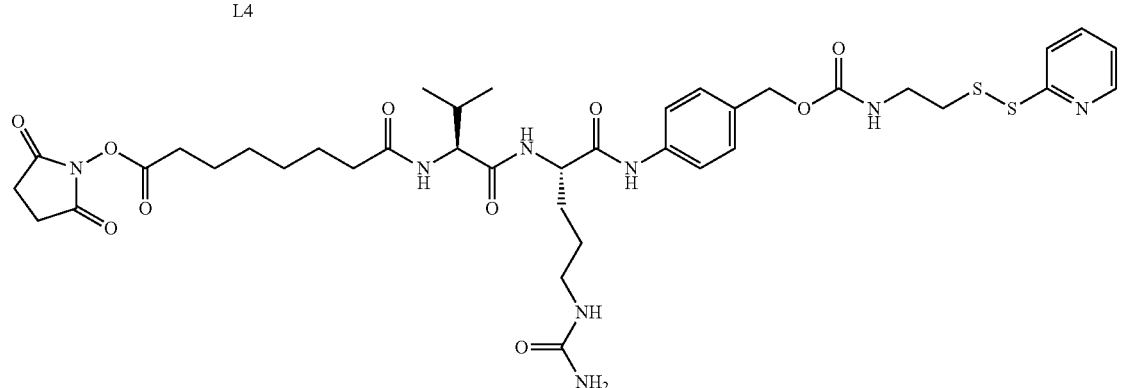

Synthesis of L3 (Ex. 88)

(9H-fluoren-9-yl)methyl ((S)-3-methyl-1-(((S)-1-((4-(((((4-nitrophenoxy)carbonyl)oxy)methyl)phenyl)amino)-1-oxo-5-ureidopentan-2-yl)amino)-1-oxobutan-2-yl)carbamate L1 (500 mg, 0.652 mmol), 2-(pyridin-2-yldisulfanyl)ethanamine hydrochloride (153 mg, 0.685 mmol), and N-methylmorpholine (0.143 mL, 1.30 mmol) were dissolved in N,N-Dimethylacetamide (3 mL). The reaction mixture was aged for 16 h at RT and purified by reverse phase chromatography on a Waters Xbridge C18 column (5 uM, 30×250 mm) using a gradient of 5-80% ACN/water with 0.1% TFA over 20 min at 40 mL/min. The product was lyophilized to give L3 as a solid. MS(m/z): 814 (M+1).

Synthesis of L4 (Ex. 89)

(9H-fluoren-9-yl)methyl ((S)-3-methyl-1-oxo-1-(((S)-1-oxo-1-((4-((((2-(pyridin-2-yldisulfanyl)ethyl)carbamoyl)oxy)methyl)phenyl)amino)-5-ureidopentan-2-yl)amino)butan-2-yl)carbamate L3 (343 mg, 0.421 mmol) and piperidine (200 uL, 2.02 mmol) were dissolved in N,N-Dimethylacetamide (3 mL). The reaction mixture was aged for 10 min at RT, quenched with trifluoroacetic acid (156 uL, 2.02 mmol), and purified by reverse phase chromatography on a Waters Xbridge C18 column (5 uM, 30×250 mm) using a gradient of 5-40% acetonitrile/water with 0.1% trifluoroacetic acid over 20 min at 40 mL/min. The product was lyophilized to give L4 as a solid. MS(m/z): 592 (M+1).

Synthesis of L6 (Ex. 90)

To a solution of 4-((S)-2-((S)-2-amino-3-methylbutanamido)-5-ureidopentanamido)benzyl (2-(pyridin-2-yldisulfanyl)ethyl)carbamate L4 (238 mg, 0.346 mmol) in dimethylsulfoxide (1.5 mL) was added a solution of bis(2,5-dioxopyrrolidin-1-yl) octanedioate L5 (509 mg, 1.382 mmol) and triethylamine (0.096 mL, 0.691 mmol). The reaction mixture was aged for 15 min and purified on a silica gel column (80 g) using a gradient of 1-10% methanol/dichloromethane over 30 min at 60 mL/min to give L6 as a solid. MS(m/z): 845 (M+1)

Synthesis of L8 (Ex. 91)

RNA compound L7 (163 mg, 0.024 mmol) and 2-azidoethanamine hydrochloride (30 mg, 0.245 mmol) were dissolved in an argon degassed, 3:1 mixture of N,N-Dimethylacetamide:water (2 mL). An argon degassed solution of copper (I) bromide dimethyl sulfide complex (12 mg, 0.059 mmol) was added and the mixture was aged at 45° C. for 16 h. The mixture was quenched with a 0.5 M solution of EDTA (3 mL) and let stand for 15 min. The product was isolated by spin dialysis against water (3×) followed by lyophilization to give a solid. MS(m/z): 7086.

Synthesis of L9 (Ex. 92)

RNA compound L8 (46 mg, 6.49 µmol) and N-methylmorpholine (7.1 mL, 65 µmol) were dissolved in water (250 µL) and DMSO (250 µL) at 10° C. To this mixture was added a solution of 2,5-dioxopyrrolidin-1-yl 8-(((S)-3-methyl-1-oxo-1-(((S)-1-oxo-1-((4-((((2-(pyridin-2-yldisulfanyl)ethyl)carbamoyl)oxy)methyl)phenyl)amino)-5-ureidopentan-2-yl)amino)butan-2-yl)amino)-8-oxooctanoate L6 (18 mg, 21 µmol) dissolved in DMSO (500 µL). The reaction mixture was aged for 16 h, diluted with water (1.5 mL) and purified by ion pairing chromatography on a Waters Xbridge phenyl column (5 µM, 19×250 mm) using a gradient of 0-55% acetonitrile/water with 100 mM triethylammonium acetate over 15 min at 20 mL/min. The product was isolated by spin dialysis against water (3×) followed by lyophilization to give a solid. MS(m/z): 8547.

Synthesis of L10-Seq 463 (Ex. 93)

RNA compound L9 (11 mg, 1.29 µmol) was dissolved in trifluoroethanol containing 50 mM acetic acid (500 µL). To this solution was added peptide Seq 463 (8.66 mg, 5.15 µmol) dissolved in trifluoroethanol containing 50 mM acetic acid (1000 µL). The mixture was aged for 10 min, quenched with N-methylmaleimide (1.9 mg, 44 µmol), and purified by ion pairing chromatography on a Waters Xbridge phenyl column (10 µM, 19×250 mm) using a gradient of 5-95% acetonitrile/water with 100 mM triethylammonium acetate over 15 min at 20 mL/min. The product was isolated by spin dialysis against water (3×) followed by lyophilization to give a solid. MS(m/z): 11687.

Synthesis of L11-Seq 463-j (Ex. 94)

A solution of L10-Seq 463 (2.46 mg, 0.27 µmol) dissolved in DI water (300 µL) was added to B2 (3.1 mg, 0.27 µmol) and heated at 90° C. for 1 min. Solution was lyophilized to give duplex as a white solid. MS(m/z) passenger strand: 9267, guide strand: 11686.

Additional Synthesis of L10 Peptide Conjugates and L11 Duplexes

Additional L10 conjugates of peptide sequences and the corresponding duplexes L11 were prepared in a manner analogous to that detailed above.

Section M. Synthesis of Guide Strand Position 2'-10,15 Disulfide Peptide Conjugates

Examples 95-98

Scheme 24 is shown in FIG. 24A-1 to FIG. 24B-2.

Synthesis of M1 (Ex. 95)

3-(Pyridin-2-yldisulfanyl)propanoic acid (506 mg, 2.35 mmol), 2-azidoethanamine hydrochloride (317 mg, 2.59 mmol), 1-ethyl-3-(3-dimethylaminopropyl)carbodiimide (496 mg, 2.59 mmol), 1-hydroxy-7-azabenzotriazole (199 mg, 1.46 mmol), and n-methylmorpholine (0.44 mL, 4.7 mmol) were dissolved in dichloromethane (25 mL). The mixture was aged for 1 h, diluted with saturated sodium bicarbonate solution (25 mL) and organic layer separated. Extracted aqueous later with dichloromethane (2×25 mL), dried combined organics over anhydrous sodium sulfate, filtered off solids and concentrated in vacuo. The mixture was purified on a silica gel column (80 g) using a gradient of 0-50% ethyl acetate/dichloromethane over 15 min at 30 mL/min to give a clear oil of M1. MS(m/z): 284.

Synthesis of M2 (Ex. 96)

RNA compound L7 (180 mg, 26 µmol) and M1 (59 mg, 208 µmol) were dissolved in a 100 mM, pH 5.5 MES buffer (3.6 mL) and acetonitrile (0.9 mL). This mixture was degassed with argon for 15 min. To this solution was added a degassed solution of copper (I) bromide dimethyl sulfide complex (13 mg, 65 µmol) dissolved in acetonitrile (0.45 mL) and aged at RT for 28 h. The mixture was quenched with a 100 mM, pH 8 solution of EDTA (5 mL) and allowed to stand for 15 min. The mixture was purified by ion pairing chromatography on a Waters Xbridge phenyl column (5 µM, 30×150 mm) using a gradient of 0-30% acetonitrile/water with 100 mM triethylammonium acetate over 15 min at 30 mL/min. The product was isolated by spin dialysis against water (3×) followed by lyophilization to give a solid of M2. MS(m/z): 7481.

Synthesis of M3-Seq 463 (Ex. 97)

RNA compound M2 (27.3 mg, 3.65 µmol) was dissolved in trifluoroethanol containing 50 mM acetic acid (1300 µL).

To this solution was added peptide Seq 463 (15.4 mg, 9.13 µmol) dissolved in trifluoroethanol containing 50 mM acetic acid (1300 µL). The mixture was aged for 10 min, quenched with N-methylmaleimide (10.1 mg, 91 µmol), and purified by ion pairing chromatography on a Waters Xbridge phenyl column (10 µM, 19×250 mm) using a gradient of 5-80% acetonitrile/water with 100 mM triethylammonium acetate over 15 min at 20 mL/min. The product was isolated by spin dialysis against water (3×) followed by lyophilization to give a solid of M3-Seq 463. MS(m/z): 10624.

Synthesis of M4-Seq 463-j (Ex. 98)

A solution of B2 (2.18 mg, 0.24 µmol) dissolved in DI water (290 µL) was added to M3-Seq 463 (2.5 mg, 0.24 µmol) and heated at 90° C. for 1 min. This solution was lyophilized to give duplex M4-Seq 463-j as a white solid. MS(m/z) passenger strand: 9267, guide strand: 10621

Additional Synthesis of M3 Peptide Conjugates and M4 Duplexes

Additional M3 conjugates of peptide sequences and the corresponding duplexes M4 were prepared in a manner analogous to that detailed above.

Section N. Synthesis of Guide Strand Position 2'-15 Disulfide Peptide Conjugates Examples 99-100

Scheme 25 is shown in FIG. 25A to FIG. 25B-2.

Synthesis of N3-Seq 283 (Ex. 99)

RNA compound N2 (11 mg, 1.54 µmol; prepared as detailed in Section M for the di-click substrate) was dissolved in trifluoroethanol containing 50 mM acetic acid (1300 µL). To this solution was added peptide seq283 (3.57 mg, 2.31 µmol) dissolved in trifluoroethanol containing 50 mM acetic acid (1300 µL). The mixture was aged for 10 min, and purified by ion pairing chromatography on a Waters Xbridge phenyl column (10 µM, 19×250 mm) using a gradient of 5-80% acetonitrile/water with 100 mM triethylammonium acetate over 15 min at 20 mL/min. The product was isolated by spin dialysis against water (3×) followed by lyophilization to give a solid. MS(m/z): 8600.

Synthesis of N4-Seq 283-k (Ex. 100)

A solution of B2 (5.65 mg, 0.609 µmol) dissolved in DI water (423 µL) was added to N3-Seq 283 (5.24 mg, 0.609 µmol) and heated at 90° C. for 1 min. Solution was lyophilized to give duplex as a white solid. MS(m/z) passenger strand: 9268, guide strand: 8601.

Additional Synthesis of N3 Peptide Conjugates and N4 Duplexes

Additional N3 conjugates of peptide sequences and the corresponding duplexes N4 were prepared in a manner analogous to that detailed above.

Section O. Synthesis of Guide Strand Position 2'-15 ECL Peptide Conjugates

Examples 101-103

Scheme 26 is shown in FIG. 26A-1 to FIG. 26B-2.

Synthesis of O2 (Ex. 101)

RNA compound O1 (20.7 mg, 2.97 µmol; prepared in an anlogous manner to L8) was dissolved in 100 mM NaHCO$_3$ (400 µL) and DMSO (300 µL). To this mixture was added a solution of 2,5-dioxopyrrolidin-1-yl 8-(((S)-3-methyl-1-oxo-1-(((S)-1-oxo-1-((4-(((2-(pyridin-2-yldisulfanyl)ethyl)carbamoyl)oxy)methyl)phenyl)amino)-5-ureidopentan-2-yl)amino)butan-2-yl)amino)-8-oxooctanoate L6 (6.28 mg, 7.43 µmol) dissolved in DMSO (250 µL). The reaction mixture was aged for 1.5 h, diluted with water (1.5 mL) and purified by ion pairing chromatography on a Waters Xbridge phenyl column (5 µM, 19×250 mm) using a gradient of 0-60% acetonitrile/water with 100 mM triethylammonium acetate over 15 min at 20 mL/min. The product was isolated by spin dialysis against water (3×) followed by lyophilization to give a solid. MS(m/z): 7696.

Synthesis of O2-Seq 463 (Ex. 102)

RNA compound O2 (10 mg, 1.30 µmol) was dissolved in trifluoroethanol containing 50 mM acetic acid (1000 µL). To this solution was added peptide Seq 463 (3.28 mg, 1.95 µmol) dissolved in trifluoroethanol containing 50 mM acetic acid (500 µL). The mixture was aged for 1 hr and purified by ion pairing chromatography on a Waters Xbridge phenyl column (5 µM, 19×250 mm) using a gradient of 5-90% acetonitrile/water with 100 mM triethylammonium acetate over 15 min at 20 mL/min. The product was isolated by spin dialysis against water (3×) followed by lyophilization to give a solid. MS(m/z): 9268.

Synthesis of O3-Seq 463-k (Ex. 103)

A solution of O2-Seq 463 (3.02 mg, 0.326 µmol) dissolved in DI water (303 µL) was added to B2 (3.02 mg, 0.326 µmol) and heated at 90° C. for 1 min. Solution was lyophilized to give duplex as a white solid. MS(m/z) passenger strand: 9267, guide strand: 9264.

Additional Synthesis of O2 Peptide Conjugates and O3 Duplexes

Additional O2 conjugates of peptide sequences and the corresponding duplexes O3 were prepared in a manner analogous to that detailed above.

Section P. Synthesis of Guide Strand Position 2'-15 Cholesterol and Peptide Conjugates Examples 104-106

Scheme 27 is shown in FIG. 27A-1 to FIG. 27B-2.

Synthesis of P1 (Ex. 104)

RNA compound N2 (67.2 mg, 9.39 µmol) and diisopropylethylamine (13.1 µL, 75 µmol) was dissolved in water (750 µL), N,N-dimethylacetamide (750 µL), and tetrahydrofuran (1200 µL). To this mixture was added a solution of thiocholesterol (30.2 mg, 75 μmol) dissolved in tetrahydrofuran (300 μL). The mixture was aged for 30 min, diluted with 2M triethylammonium acetate (100 μL), and purified by ion pairing chromatography on a Waters Xbridge phenyl column (10 μM, 19×250 mm) using a gradient of 5-95% acetonitrile/water with 100 mM triethylammonium acetate over 15 min at 20 mL/min. The product was isolated by spin dialysis against water (3×) followed by lyophilization to give a solid. MS(m/z): 7451.

Synthesis of P2-Seq 32-k (Ex. 105)

A solution of P1 (1.0 mg, 0.134 μmol) dissolved in DI water (200 μL) was added to B10-Seq 32 (1.86 mg, 0.129 μmol) and heated at 90° C. for 1 min. Solution was lyophilized to give duplex as a white solid. MS(m/z) passenger strand: 13295, guide strand: 7450.

Synthesis of P2-Seq 32-m (Ex. 106)

Guide strand P1 was also duplexed with passenger strand F6-Seq 32 in a manner identical to that detailed above in Example 105 to provide duplex P2-Seq 32-m:

Scheme 28 is shown in FIG. 28-1 to FIG. 28-2.

Section Q. 3' Enzymatically Cleaved Linker Bis Peptides

Examples 107-109

Scheme 29 is shown in FIG. 29A-1 to FIG. 29C-2.

Synthesis of Q1 (Ex. 107)

In a Falcon tube, L6 (13.82 mg, 0.016 mmol) was dissolved in DMSO (1963 μl) and cooled to 10° C. in an ice-bath. In a separate Falcon tube, B4 (76.2 mg, 8.18 μmol) was dissolved in pH 8.3 NaHCO$_3$ 200 mM (1309 μl). The RNA solution was added to the DMSO solution and the reaction was determined complete after 5 min.

The reaction was purified by ion-pairing chromatography (GX-281, XBridge Prep Phenyl 5 um, OBD, 30×150 mm, 30 mL/min, 5-45% of 100 mM TEAA in water/100 mM TEAA in ACN, 20 min gradient). The resulting fractions were dialyzed against water 3× on Millipore 3K, 15 mL tubes, (4200 rpm, 4° C.) and then lyophilized to afford a white solid. Expected mass: 10052.834. Found mass: 10051.0.

Synthesis of Q2-Seq 74 (Ex. 108)

See Synthesis of B10-Seq74 for reaction procedure. Q2-Seq 74—Found mass: 13940.012.

Synthesis of Q3-Seq 74-b (Ex. 109)

See Synthesis of B11-Seq74 for reaction procedure. Q3-Seq 74-b—Found mass: 20792.

Section R. 5',3' Di-Lipopeptide Conjugates

Examples 110-112

Scheme 30 is shown in FIG. 30A to FIG. 30E-3.

Synthesis of R2 (Ex. 110)

L6 (23.2 mg) was dissolved in formamide (300 μl) and DMSO (300 μl), then added R1 (50 mg) dissolved in pH 8.3 200 mM NaHCO$_3$ aqueous solution (600 μl). After 5 min, precipitation appeared. Additional DMSO (300 μl) was added, whereupon most of solids redissolved. After a 15 min incubation, the reaction was purified using an XBridge Prep Phenyl column (5 uM, 30×150 mm) using a gradient of 5-45% CH$_3$CN (100 mM TEAA)/water (100 mM TEAA), 20 min at 20 mL/min, collecting at 260 nm. The product fractions were diluted with water to reduce the CH$_3$CN content to below 20% and centrifugal dialyzed four times against water over a 3K membrane. The retentate was frozen and lyophilized to a white solid.

Synthesis of R3 (Ex. 111)

Dissolved R2 in 500 ul of water, dissolved Compound 35 of SCHEME 38 separately in 500 ul of water, then added GS solution to PS solution, vortexed thoroughly at RT, then checked analytical SAX HPLC confirming the formation of duplex. The solution was freeze dried to afford the duplex as a white amorphous solid.

Synthesis of R4-Seq 27-1 (Ex. 112)

Dissolved siRNA R3 in 2,2,2-trifluoroethanol containing 50 mM acetic acid (500 uL). Dissolved peptide in 2,2,2-trifluoroethanol containing 50 mM acetic acid (500 uL), then added 8 M aqueous guanidinium hydrochloride (30 uL). The siRNA solution was added to the peptide solution to give a clear solution. After 1 h, the reaction mix was diluted with formamide (1 mL) and was purified on neutral SAX system (Buffer A: 1:1 water:TFE 20 mM MES pH 5.5 Buffer B: 1:1 water:TFE 20 mM MES pH 5.5 1M CsCl) in two runs. The product fractions were diluted with water to reduce the TFE content to below 50% and dialyzed three times against water over a 3K membrane. The retentate was frozen and lyophilized to a white solid.

Additional Synthesis of R3 Peptide Conjugates and R4 Duplexes

Additional R3 conjugates of peptide sequences and the corresponding R4 duplexes were prepared in a manner analogous to that detailed above.

Section S. Preparation of Alternative TetraGalNAc Ligands

Examples 113-115

Synthesis of TetraGalNAc Ligand Compounds 17a, 17b and 17c

The following Scheme 31 was used to prepare TetraGalNAc Compounds 17a, 17b and 17c.

SCHEME 31
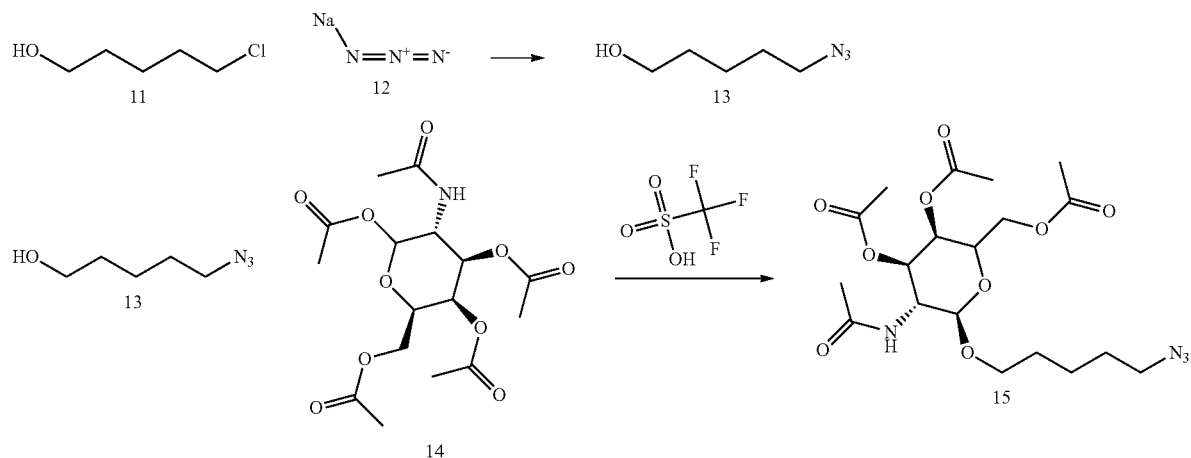
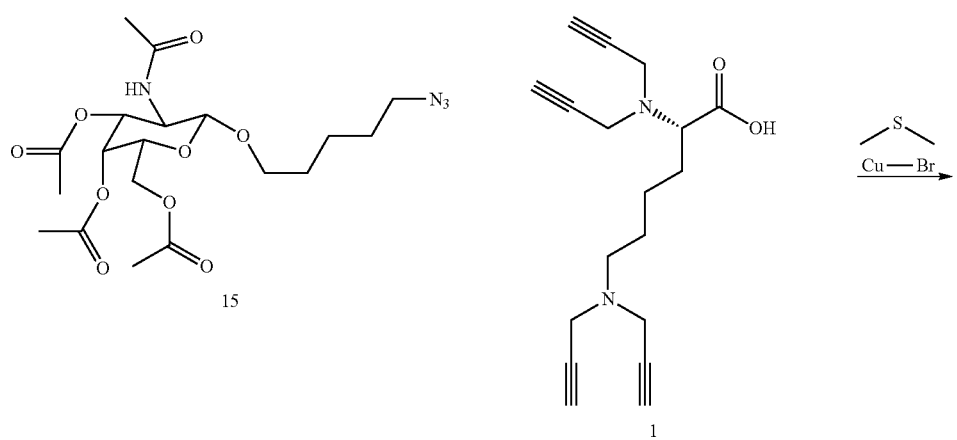
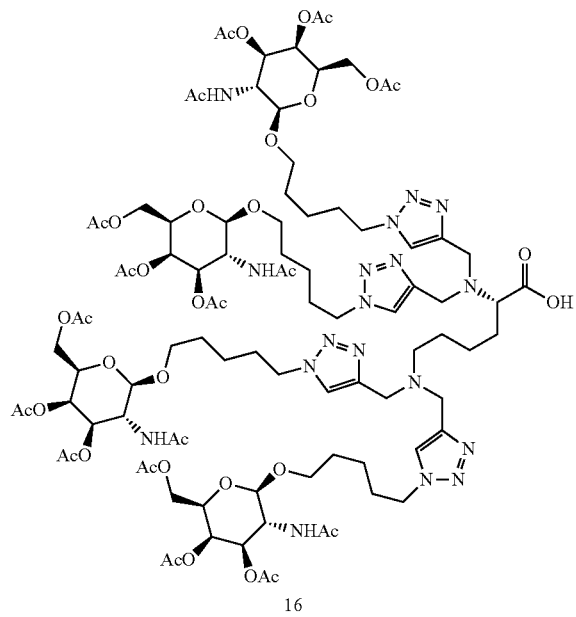

-continued

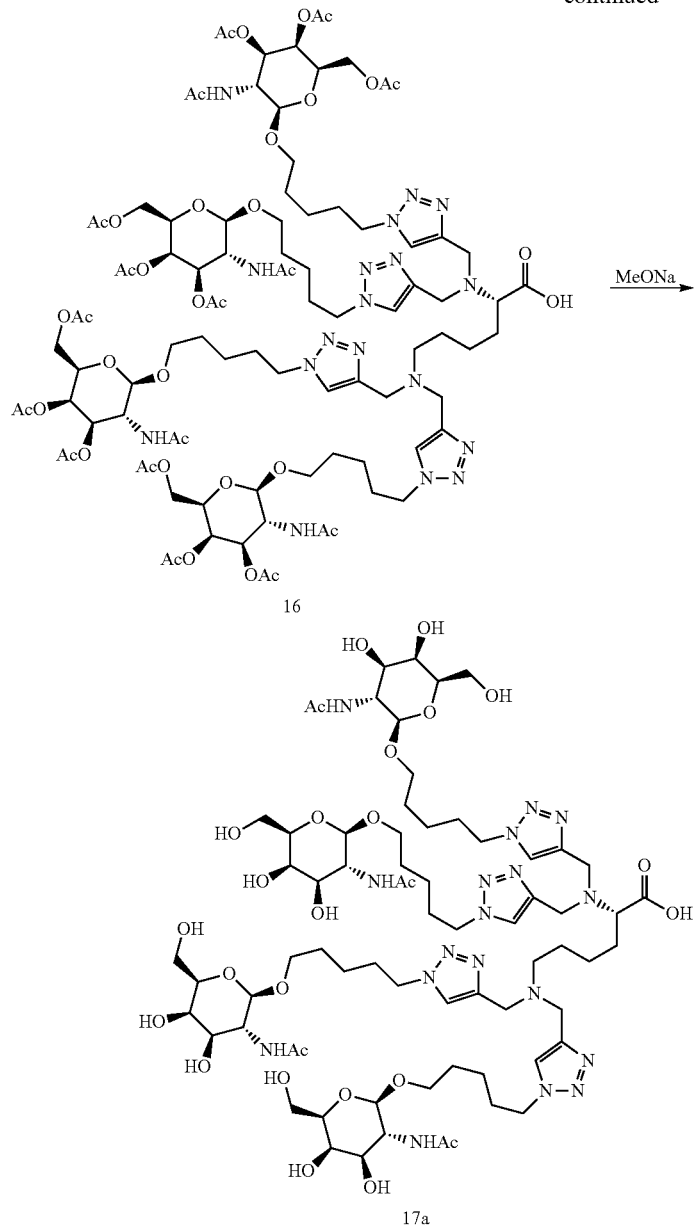

Synthesis of Compound 13

To a solution of 5-chloro-1-pentanol (3.0 g, 24.47 mmol) Compound 11 in DMF (20 mL) was added sodium azide (1.909 g, 29.4 mmol) Compound 12. After being stirred at 60° C. for overnight, the reaction mixture was concentrated in vacu. The residue was purified by silica gel chromatography (EtOAc/Hexane 1:3), to give product Compound 13 as clear liquid. $^1$H NMR (500 MHz, CDCl$_3$) δ 3.62 (m, 2H), 3.25 (t, J=6.9 Hz, 2H), 1.63-1.53 (m, 4H), 1.45-1.40 (m, 2H).

Synthesis of Compound 15

Compound 13 (0.796 g, 6.16 mmol) and D-galactosamine pentaacetate (2.00 g, 5.14 mmol) Compound 14 were suspended in 20 mL DCM, followed by addition of trifluoromethanesulfonic acid (0.154 g, 1.027 mmol). The resulting mixture was brought to reflux for overnight. LC-MS indicated completed conversion of SM, the reaction mixture was diluted with EtOAc and washed with sodium bicarbonate and dried over sodium sulfate. Solvent was removed and the residue was purified by ISCO DCM/MeOH from 100/0 to 90/10 over 30 min to afford Compound 15 as a white solid. $^1$H NMR (500 MHz, CDCl$_3$) δ: 1.97 (6H, s), 2.02 (6H, s), 2.06 (6H, s), 2.15 (6H, s), 3.28 (6H, t, J=6.89 Hz), 3.50 (3H, dt, J=9.63, 6.66 Hz), 3.68 (1H, q, J=5.98 Hz), 3.94-3.92 (7H, m), 4.16-4.15 (5H, m), 4.73 (2H, d, J=8.34 Hz), 5.31 (2H, dd, J=11.16, 3.48 Hz), 5.40-5.38 (5H, m). Calculated mass: [M+H]$^+$: C$_{19}$H$_{31}$N$_4$O$_9$, 459.2; observed: 459.4.

Synthesis of Compound 16

Lys-alkyne Compound A1 (130 mg, 0.436 mmol) and GalNAc Azide 6 (999 mg, 2.178 mmol) were dissolved in THF (5 mL, degassed). Copper (I) bromide-dimethyl sulfide complex (17.91 mg, 0.087 mmol) was added in one portion to the reaction mixture and the THF solution was stirred for overnight at 40° C. The reaction color changed to blue/green, indicating $Cu^{2+}$, fresh sodium ascorbate 37 mg in 0.2 mL of water was added to reaction mixture and allowed to react overnight. The reaction was concentrated and purified by RP HPLC 5-60 MeCN(0.5% TFA)/Water(0.5% TFA) over 20 min. The collected fractions were combined and lyophilized to afford Compound 8 as a white solid. Calculated mass: $[M+3H]^{3+}$: $C_{94}H_{145}N_{18}O_{38}$, 2134.0, m/z=711.3; observed: 711.9.

Synthesis of Compound 17a (Ex. 113)

To protected TetraGalNAc Compound 8 (300 mg, 0.141 mmol) in DCM/MeOH=1/1 5 mL at 0° C. was added Sodium Methoxide (91 mg, 1.688 mmol). The reaction was stirred for 1 h and quenched by addition of 2 mL of water. Volatile solvent was removed, and the reaction mixture was purified by P4 bio gel with water and the collect fractions were combined and lyophilized to afford Compound 9 as a white solid. Calculated mass: $[M+3H]^{3+}$: $C_{70}H_{121}N_{18}O_{26}$, 1629.9, m/z=543.3; observed: 543.8; $[M+2H]^{2+}$: $C_{70}H_{120}N_{18}O_{26}$, 1628.9, m/z=814.5; observed: 814.9.

Synthesis of Compounds 17b and 17c (Ex. 114 and Ex. 115)

Syntheses of Compounds 17b and 17c which have the following structures were accomplished in a manner similar to that used for Compound 17a using the appropriate azide source.

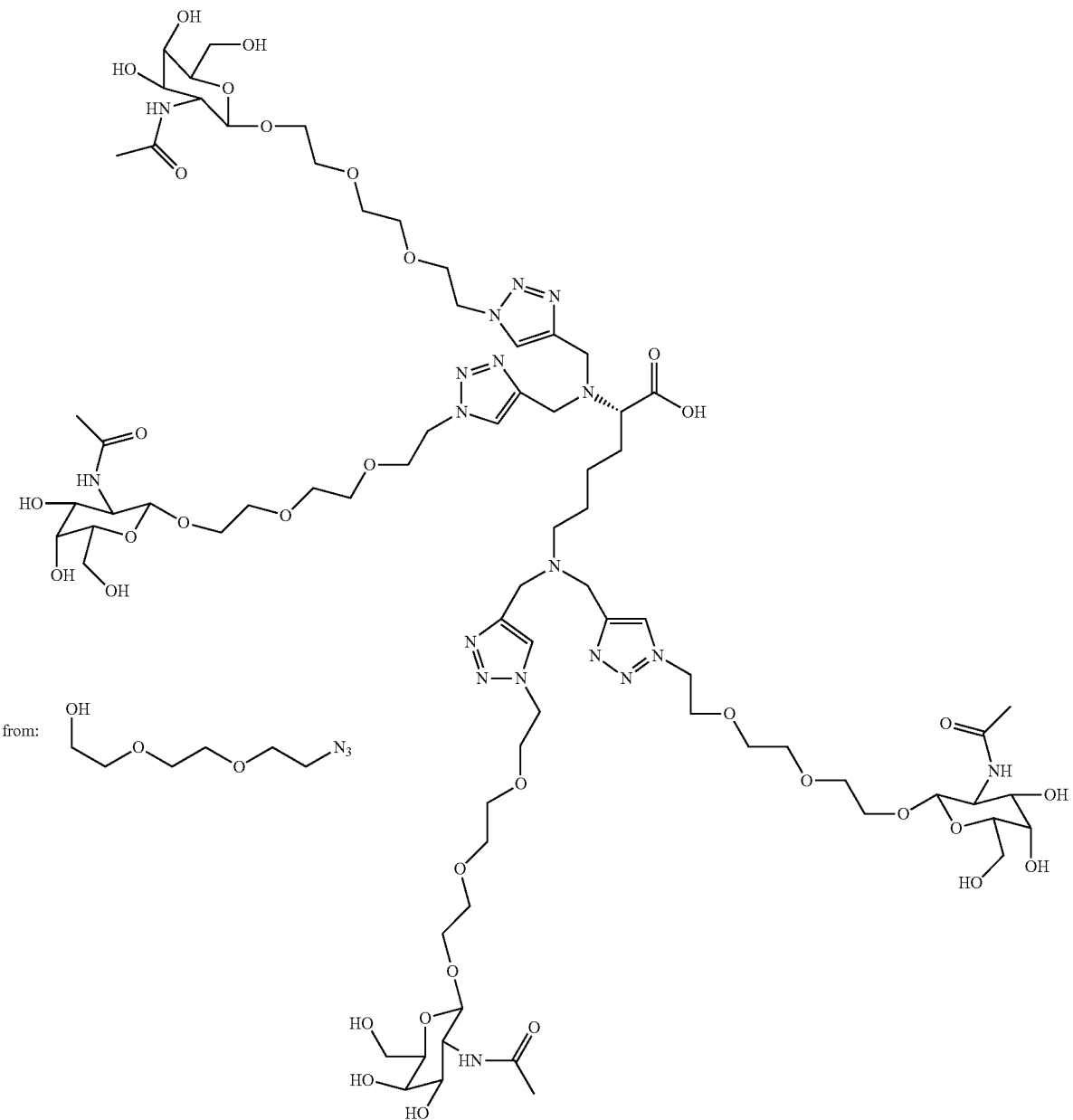

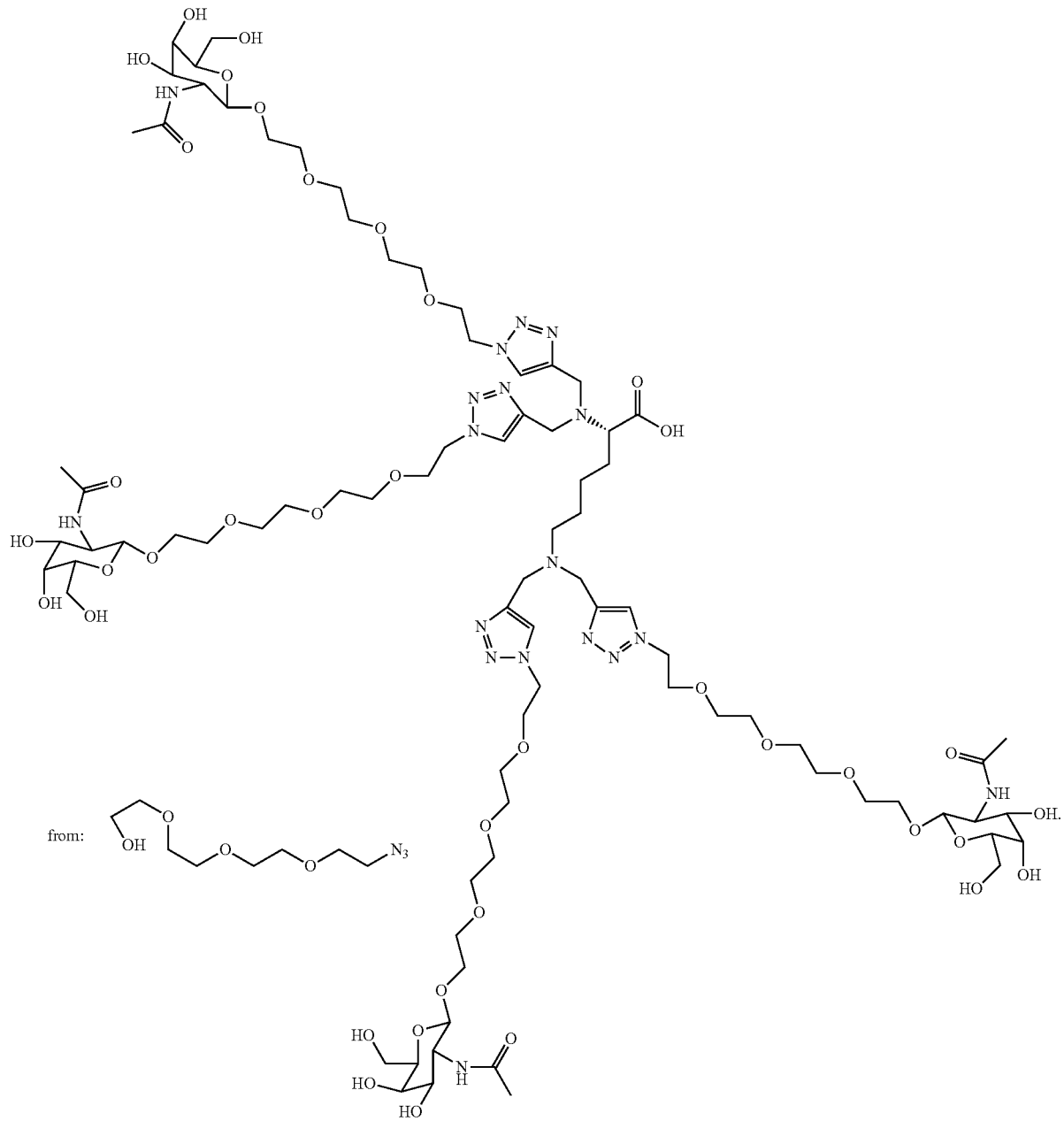

17c

Example 116

Scheme of Conjugation of TetraGalNAc Ligands

Scheme 32 as shown in FIG. 31A and FIG. 31B shows a general scheme that can be used to prepare tetraGalNAc-siRNA conjugates.

Using the general scheme 32, Conjugates 10-1, 10-2, 10-3, 10a-1, 17a-1, 17b-1, 17c-1 can be obtained. The coupling procedure can be performed on a preformed siRNA duplex or on a single strand followed by annealing. Alternatively, one can utilize the protocol outlined in *Bioconjug Chem.* 2011, 22, pp. 1723-8.

Example 117

Synthesis of TetraGalNAc-siRNA Conjugate (A11-a) Via TetraGalNAc Acetate Compound A9

To a solution of tetraGalNAc acetate (A9, 58.7 mg, 0.027 mmol) in acetonitrile (1.5 ml) was added DIPEA (2.2 mg, 0.055 mmol) and HATU (10.44 mg, 0.027 mmol). The mixture was stirred at room temperature for 30 min, transferred into a solution siRNA (0.014 mmol) in water (1.5 ml) and acetonitrile (1.5 ml) via a syringe pump over 20 min, and stirred for 15 min before it was concentrated under vacuum down to 1.5 mL. Sodium carbonate (218 mg, 2.059 mmol) was then added, followed by MeOH (0.50 ml). The resulted solution was stirred at room temperature for 16 h, concentrated, purified via dialysis, and lyophilized to yield Conjugate A11-a.

The coupling protocol described for A11-a can also be performed with A10 instead of A9.

Examples 118-119

Synthesis of Conjugates A11-b and A11-c (Ex. 118 and Ex. 119)

A similar protocol was used for Conjugates A11-b and A11-c. Duplex formation with the appropriate antisense or sense strand can be performed using the protocol described for B11.

Example 120

Synthesis of 3'5' Bis TetraGalNAc-siRNA Conjugate Single Strand 18

To a solution of tetraGalNAc acid Compound 10 (41.2 mg, 0.025 mmol) in DMSO (200 uL) was added HATU (9.6 mg, 0.025 mmol) and DIPEA (17.6 uL, 0.126 mmol). The mixture was stirred at room temperature for 15 min, transferred into a solution of diamino-siRNA (18.8 mg, 2.52 umol) in water (40 uL) and DMSO (360 uL) and stirred for 30 min. The mixture was diluted with water (1.5 mL) and purified on a XBridge Prep Phenyl column (5 uM, 19×250 mm) using a gradient of 0-30% CH$_3$CN/water containing 100 mM TEAA. The fractions were concentrated via dialysis and lyophilized to yield Compound 18.

Example 121

Synthesis of 3'5' Bis TetraGalNAc-siRNA Duplex Conjugate 19-1 (Ex. 121)

Scheme 33 as shown in FIG. 32A and FIG. 32B was used to prepare TetraGalNAc-siRNA Conjugate 19-1.

A solution of 3'5' bis tetraGalNAc-siRNA conjugate 18 (13.7 mg, 1.29 umol) in water (200 uL) was added to a solution of Guide siRNA (9.3 mg, 1.35 umol) dissolved in water (100 uL) and heated at 90 C for 1 minute. The resulting solution was cooled and lyophilized to yield duplex 19-1.

Example 122

Synthesis of TetraGalNAc Ligand Compound 24 (Ex. 122)

The following Scheme 34 was used to prepare tetraGalNAc ligand Compound 24.

SCHEME 34

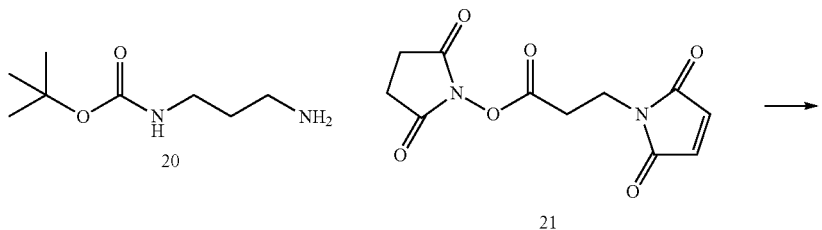

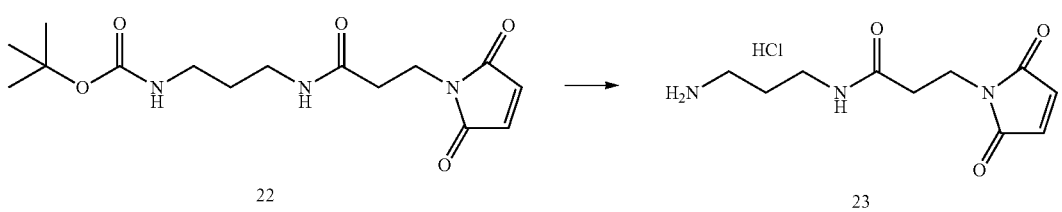

-continued
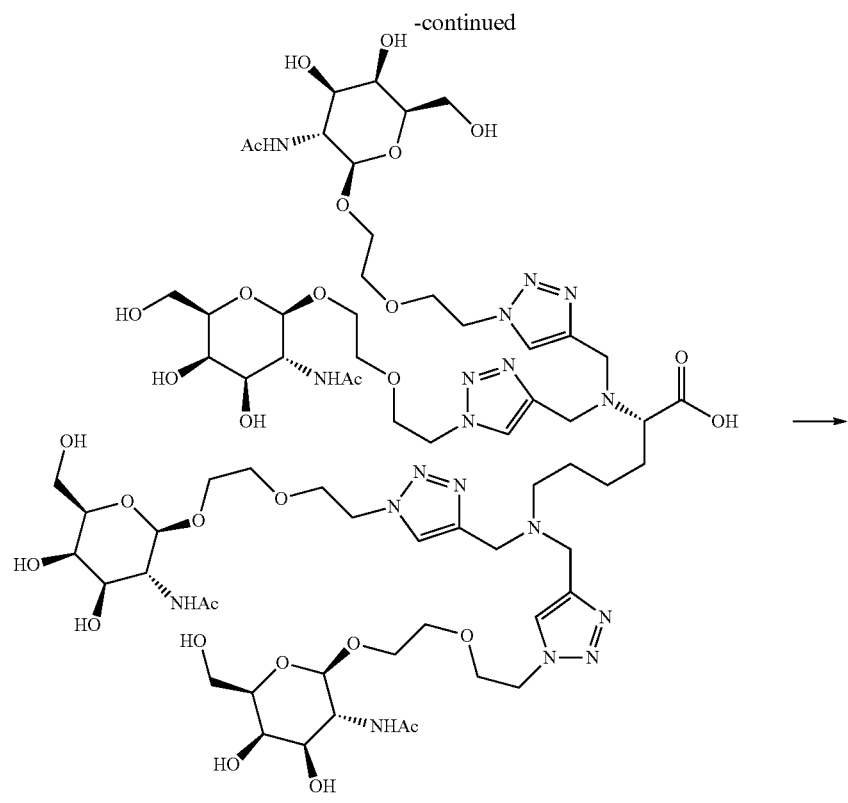
10
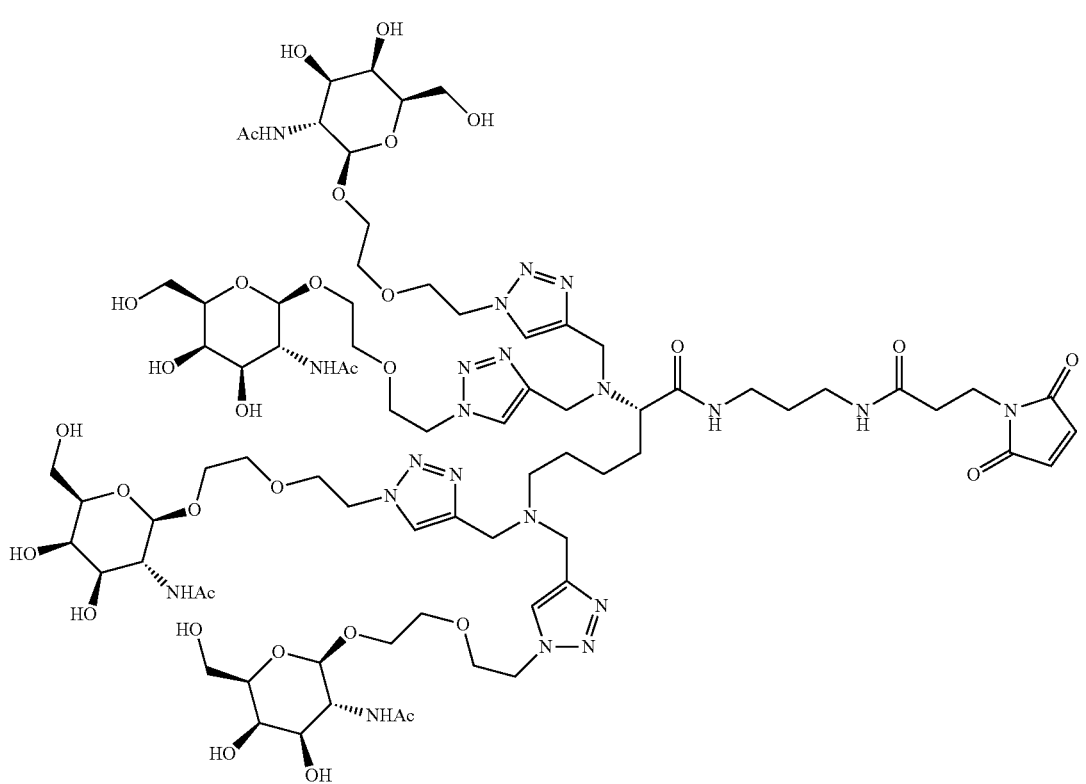
24

Synthesis of Compound 22

To a solution of N—BOC-1,3-DIAMINOPROPANE (Compound 20, 115 mg, 0.660 mmol) in 1:1 $CH_2Cl_2$/$CH_3CN$ (1 mL) at 0° C. was added a solution of 3-maleimidopropionic acid N-hydroxysuccinimide ester (Compound 21, 185 mg, 0.695 mmol) dissolved in acetonitrile (4 mL) and $CH_2Cl_2$ (1 mL). The mixture was stirred for 1 h and concentrated in vacuo. The residue was purified by silica gel chromatography (0-5% MeOH/$CH_2Cl_2$ to give product Compound 22. Calculated mass: $[M+H]^+$: $C_{15}H_{24}N_3O_5$, 326.2; observed: 326.3.

Synthesis of Compound 23

To a solution of maleimide Compound 22 (56 mg, 0.172 mmol) in $CH_2Cl_2$ (1 ml) was added a solution of 4M HCl (1 ml, 4.00 mmol) in dioxane. The mixture was stirred for 1 h and concentrated in vacuo. The residue was azeotroped with $CH_2Cl_2$ (2×) and dried under vacuum to give product Compound 23. Calculated mass: $[M+H]^+$: $C_{10}H_{16}N_3O_3$, 226.1; observed: 226.3.

Synthesis of tetraGalNAc Maleimide Compound 24 (Ex. 122)

To a solution of tetraGalNAc acid Compound 10 (100 mg, 0.061 mmol) in DMF (500 uL) was added HATU (34.9 mg, 0.092 mmol), $Et_3N$ (42.6 uL, 0.306 mmol) and N-(3-aminopropyl)-3-(2,5-dioxo-2,5-dihydro-1H-pyrrol-1-yl)propanamide hydrochloride (16.0 mg, 0.061 mmol). The mixture was stirred at room temperature for 1.5 h, acidified with TFA and purified by reverse phase 0-50% $CH_3CN$/water containing 0.1% TFA. The fractions were lyophilized to yield Compound 24. Calculated mass: $[M+2H]^{2+}$: $C_{76}H_{125}N_{21}O_{32}$, 1843.8, m/z=921.9; observed: 922.7.

Example 123

Synthesis of Compound 26

Scheme 35 as shown in FIG. 33A and FIG. 33B was used to prepare Compound 26.

To a degassed solution of 2'-3,17 propargyl siRNA (RNA 25, 33 mg, 4.49 umol) and PEG9 SPDP azide (26 mg, 36 umol, prepared from commercial PEG-azide and pyridyl disulfide reagents) in 3:1 DMA/water (1 mL) was added a degassed solution of Copper (I) Bromide-Dimethylsulfide Complex (1.8 mg, 9.0 umol). The mixture was stirred for 72 h at room temperature, diluted with water (2 mL), filtered using a 0.45 uM syringe filter and concentrated by dialysis. The concentrated mixture was purified on a XBridge Prep Phenyl column (5 uM, 19×250 mm) using a gradient of 0-50% $CH_3CN$/water containing 100 mM TEAA. The fractions were concentrated via dialysis and lyophilized to yield Compound 26.

Examples 124-125

Synthesis of Compounds 27 and 28 (Exs. 124-125)

Scheme 36 as shown in FIG. 34A to FIG. 34C was used to prepare Compounds 27 and 28.

Synthesis of Compound 27 (Ex. 124)

To a solution of 2'-3,17 click PEG9 SPDP Conjugate 26 (13.2 mg, 1.50 µmol) in water (1 mL) was added a solution of TCEP hydrochloride (9.15 mg, 32.2 umol) dissolved in water (0.5 mL). The mixture was stirred at RT for 30 min then purified on a XBridge Prep Phenyl column (5 uM, 19×250 mm) using a gradient of 5-40% $CH_3CN$/water containing 100 mM TEAA. The fractions were concentrated via dialysis and lyophilized to yield Compound 27.

Synthesis of Compound 28 (Ex. 125)

To a solution of 2'-3,17-click PEG9SH 27 (3 mg, 0.35 µmol) in pH 6.0 acetate buffer (100 uL) was added a solution of tetra GalNAc maleimide (5.1 mg, 2.77 µmol) dissolved in pH 6.0 acetate buffer (100 uL). The mixture was stirred at room temperature for 30 min then purified on a XBridge Prep Phenyl column (5 uM, 19×250 mm) using a gradient of 5-40% $CH_3CN$/water containing 100 mM TEAA. The fractions were concentrated via dialysis and lyophilized to yield Compound 28.

Example 126

Synthesis of 2'-3,17 Bis TetraGalNAc-siRNA Duplex Conjugate 29

The procedure detailed for Conjugate 19 was used to duplex 28 to make Conjugate 29.

Example 127

Synthesis of TetraGalNAc Thiol Compound 31

Scheme 37 below was used to prepare Compound 31.

SCHEME 37
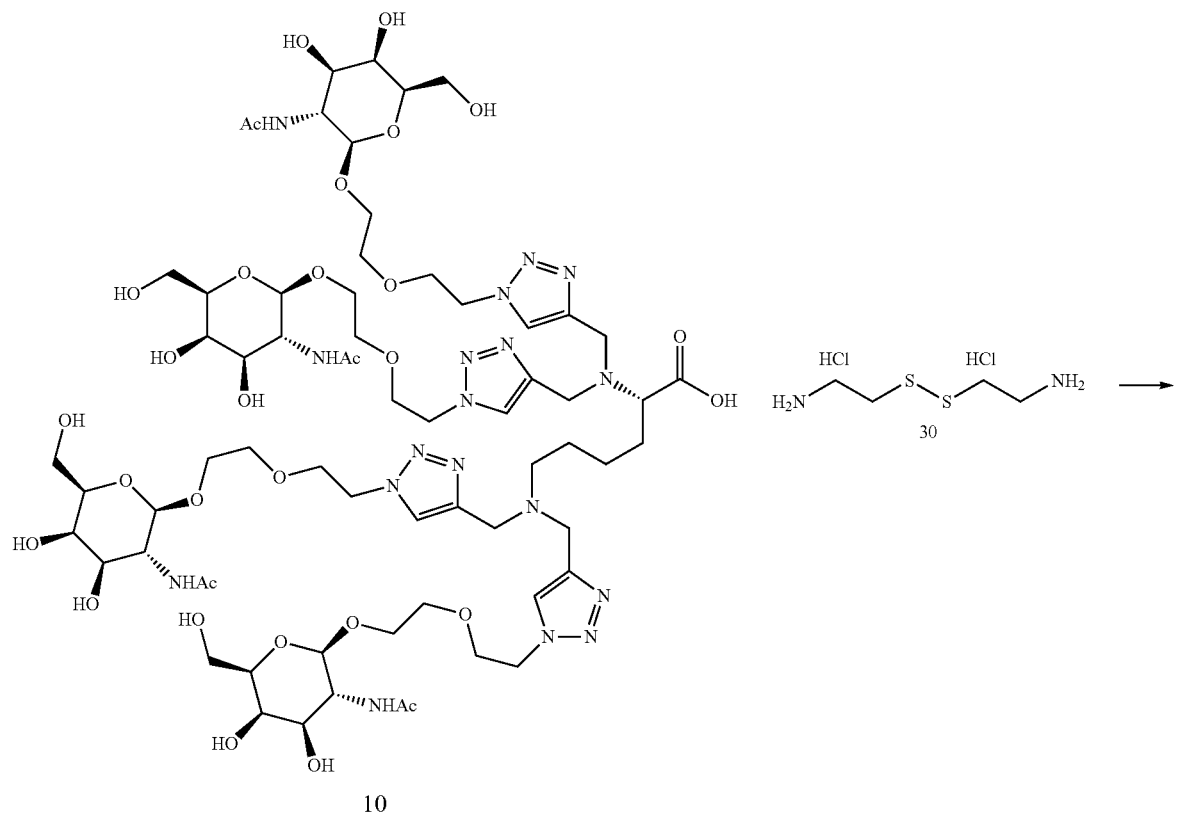
10
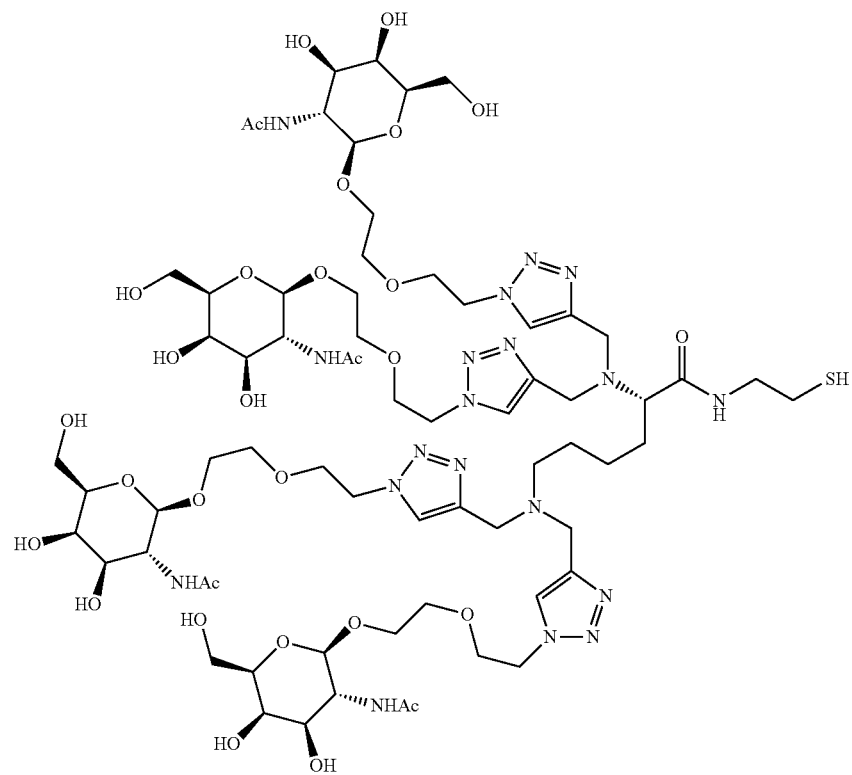
31

To a solution of tetraGalNAc acid Compound 10 (54 mg, 0.033 mmol) in N,N-dimethylacetamide (500 µl), was added crystamine dihydrochloride 30 (14.9 mg, 0.066 mmol), EDC (12.7 mg, 0.066 mmol), HOAT (10.2 mg, 0.066 mmol) and DIPEA (57.7 µl, 0.330 mmol). The mixture was stirred at room temperature for 18 h, then added a solution of DTT (50.9 mg, 0.330 mmol) in N,N-dimethylacetamide (100 µl). The mixture was stirred at room temperature for 0.5 h, acidified with TFA and purified by reverse phase 0-30% $CH_3CN$/water containing 0.1% TFA. The fractions were lyophilized to yield Compound 31. Calculated mass: $[M+2H]^{2+}$: $C_{68}H_{115}N_{19}O_{29}5$, 1695.8, m/z=847.9; observed: 848.0.

Examples 128-130

Synthesis of Conjugates 35-37

Scheme 38 as shown in FIG. 35A and FIG. 35B was used to prepare Conjugates 35-37.

Synthesis of Compound 33

To a degassed solution of 2'-click 15 GS Compound 32 (130 mg, 0.019 mmol) and (9H-fluoren-9-yl)methyl (2-azidoethyl)carbamate (29.1 mg, 0.095 mmol) in 3:1 DMA/water (2 mL) was added a solution of Copper (I) bromide-dimethylsulfide Complex (9.72 mg, 0.042 mmol) dissolved in degassed DMSO (0.32 mL). The mixture was stirred at 45° C. for 2 h, cooled to room temperature, and added pH 8 EDTA (0.5 M, 2 mL) to quench reaction. Stirred for 15 min and purified on a XBridge Prep Phenyl column (5 uM, 30×150 mm) using a gradient of 0-45% $CH_3CN$/water containing 100 mM TEAA. The fractions were concentrated via dialysis. To the combined material in water (3 mL) was added a solution of piperidine (936 µL, 1.891 mmol). The mixture was stored at 4° C. for 18 h, diluted with water (10 mL) and filtered off solids through syringe filter. Added pH 8 EDTA (0.5 M, 2 mL), concentrated via dialysis and lyophilized to yield Compound 33.

Synthesis of Compound 34

To a solution of 2'-15 click C2 NH2 GS Compound 33 (43.6 mg, 6.26 µmol) in 200 mM NaHCO3 soln (2000 µl) and formamide (1000 uL) was added a solution of N-Succinimidyl-3-[2-pyridyldithio]propionate (17.9 mg, 0.057 mmol) dissolved in DMSO (298 uL). The mixture was stirred at 10° C. for 15 min, diluted with water (10 mL) and Formamide (1 mL), and concentrated by dialysis. Added 2M TEAA (200 uL) and purified on a XBridge Prep Phenyl column (5 uM, 19×250 mm) using a gradient of 5-40% $CH_3CN$/water containing 100 mM TEAA. The fractions were concentrated via dialysis and lyophilized to yield Compound 34.

Synthesis of 2'-15 TetraGalNAc-siRNA Conjugate 35 (Ex. 128)

To a solution of 2'-15 click C2 NH2 NHS SPDP GS Compound 34 (13 mg, 1.82 µmol) in 1:1 formamide/water (200 µl) was added a solution of tetraGalNAc SH (4.62 mg, 2.72 µmol) in formamide (200 uL). The mixture was stirred at room temperature for 3.5 h, added 2M TEAA (50 uL) and purified on a XBridge Prep Phenyl column (5 uM, 19×250 mm) using a gradient of 2-35% $CH_3CN$/water containing 100 mM TEAA. The fractions were concentrated via dialy-sis and lyophilized. The resulting solid was purified on a Proteomix SAX-NP10 column (22.1×50 mm) using a gradient of 2-30% (Solvent A: 60:40 TFE/water with 40 mM Et3N, Solvent B: 60:40 TFE/water with 40 mM Et3N, 1M Guanidine HCl). The fractions were concentrated via dialysis and lyophilized to yield Conjugate 35.

Synthesis of Conjugates 36 and 37 (Ex. 129 and Ex. 130)

The procedure detailed for Conjugate 19-1 was used to duplex Conjugate 35 and the appropriate passenger strand to prepare Conjugates 36 and 37, respectively.

Examples 131-139

Synthesis of Conjugates 38-45 (Exs. 131-139)

Scheme 39 as shown in FIG. 36A to FIG. 36C, was used to prepare Conjugates 38-44.
Scheme 40. Examples of different linkers from Table 2 as shown in FIG. 37, used to conjugate tetraGalNAc to siRNA.

Step 1: Passenger-RNA and Linker, Example with Proline to Illustrate Protocol

To a solution of FMOC-PRO-OH (11.11 mg, 0.033 µmol) in 120 µL DMSO were added DIPEA (43.2 µl, 0.247 µmol) followed by HATU (10.96 mg, 0.029 µmol). The mixture, slightly yellow, was stirred at room temperature for 30 min. The mixture was then added to a solution of the oligonucleotide passenger strand TEAA salt (60 mg, 8.24 µmol) in 500 µL of (10% H2O/DMSO), and the mixture continued to stir at room temperature for one hour. The reaction mixture showed desired product via LC-MS. To the reaction mixture was added diethylamine (43.0 µl, 0.412 µmol) and the mixture was stirred for one hour, confirmed desired product via LC-MS. The reaction mixture was purified by centrifugal dialysis using 3 kDa cut-off membrane. The process was repeated three times with water (14 mL each time). The resulting solution was concentrated, frozen, and lyophilized overnight to yield product as a white fluffy solid. LC/MS confirms product [7384.9].

Step 2: TetraGalNAc-Linker-Passenger RNA

To a solution of TetraGalNAc Compound 10 (53.2 mg, 0.033 µmol) in 532 µL DMSO were added DIPEA (42.6 µl, 0.244 µmol) followed by HATU (12.36 mg, 0.033 µmol). The mixture, slightly yellow, was stirred at RT for 30 min. The mixture was then added to a solution of the linker-oligonucleotide passenger strand in 500 µL of DMSO, and the mixture continued to stir at room temperature for two hours. LC/MS showed desired product. The reaction mixture was subjected to centrifugal dialysis using 3 kDa cut-off membrane. The process was repeated three times with water (14 mL each time). The resulting solution was purified by Gilson PLC 2020 using XBRIDGE PHENYL, 10-27% $CH_3CN$ with 200 µM TEAA for 35 minutes. Collection solution was concentrated via centrifugal dialysis using 3 kDa cut-off membrane. The resulting concentrated solution was treated with 1.0N NaCl and centrifugal dialysis. The process was repeated five times with water (14 mL each time). The resulting concentrated solution (~1.5 mL) was frozen and lyophilized overnight to yield product as a white fluffy solid. LC/MS confirms product [9002.5].

Step 3: Duplex Formation

To a TetraGalNAc-linker-RNA (18.5 mg, 2.055 µmol) in 1.5 mL of water was duplexed with ApoB guide strand (14.12 mg, 2.055 µmol) in 1.5 mL of water. The mixture was heated at 90° C. for 5 min with stir bar. The duplex was cooled and stir bar removed. The solution was lyophilized over two days to yield desired duplex Conjugate 38 as a white fluffy solid. LC/MS confirms product [16048].

ALL the remaining conjugates were prepared using the same general procedure.

Examples 140-142

Synthesis of Compounds/Conjugates 46-48

Scheme 41 as shown in FIG. 38A to FIG. 38E was used to prepare Compounds and/or Conjugates 46-48.

Synthesis of RNA Compound 46 (Ex. 140)

SPDP Acid (2.2 mg, 10.3 µmol) was dissolved DMSO 100 µL and N,N-diisopropylethylamine (14.0 µl, 0.08 mmol), HATU (19.6 mg, 0.051 mmol) were added sequentially. RNA (15 mg, 2.06 µmol) in 200 µL of DMSO:Water (9:1) was added and the resulting reaction mixture was stirred for 1 h, reaction was quenched by addition of 3 mL water and dialyzed down to 500 µL, diluted by formamide to 3 mL and purified by SAX (Buffer A: 60% TFE in water, 20 mM TEA, Buffer B: 60% TFE in water, 20 mM TEA, 1 M CsCl, gradient A/B from 100/0 to 35/65 over 15 min). The collected fractions were combined and dialyzed against water and lyophilized to afford Compound 46 as a white solid. Calculated mass: $[M-H]^-$: $C_{234}H_{300}F_8N_{72}O_{150}P_{23}S_3$, 7480.1; observed: 7483.0.

Synthesis of Conjugate 47 (Ex. 141)

RNA Compound 46 (22 mg, 2.9 µmol) and tetraGalNAc Thiol Compound 31 (10.0 mg, 5.9 µmol) were dissolved in formamide:pH=6.8 Tris buffer (3:1) 400 µL and stirred for 1 h. The reaction mixture was purified by SAX (Buffer A: 60% TFE in water, 20 mM TEA, Buffer B: 60% TFE in water, 20 mM TEA, 1 M CsCl, gradient A/B from 100/0 to 35/65 over 15 min). The collected fractions were combined and dialyzed against water and lyophilized to afford Conjugate 47 as a white solid. Calculated mass: $[M-H]^-$: $C_{297}H_{410}F_8N_{90}O_{179}P_{23}S_3$, 9063.9; observed: 9066.2.

Synthesis of Conjugate 48 (Ex. 142)

Conjugate 47 (10.9 mg, 1.20 µmol) and guide strand (7.81 mg, 1.14 µmol) were mixed in RNAse free water 1 mL for 2 h. The reaction mixture was lyophilized to afford duplex Conjugate 48 in quantitative yield.

Examples 143-145

Synthesis of Compounds/Conjugates 49-51

Scheme 42 as shown in FIG. 39A to FIG. 39C was used to prepare Compounds and/or Conjugates 49-51.

Synthesis of RNA Compound 49 (Ex. 143)

33.3 mg of siRNA passenger strand was weighed into a 4 mL vial then 1 mL 100 mM NaHCO3 was added to dissolve. Added 0.86 uL of propionic anhydride and let stir at RT. After aging ~2 h, spin dialyzed 3× against water. Filtered through frit and the solution was dried via lypophilization to afford RNA Compound 49.

Synthesis of Conjugate 50 (Ex. 144)

Step 1.
Charge 2.8 mg azide, 25.7 mg siRNA, 25 ml N2 sparged DMSO and 4 ml water to 40 mL vial. Sparge with $N_2$. Charge 2.98 mL of Cu/ligand solution ($N_2$ sparged, 20/100 umol in 10 ml DMSO). Agitate at RT under sparged $N_2$.
Step 2.
Charge Compound 10 and 1 ml DMSO. Charge 6 uL of DIPEA and agitate for 2 min. Charge 6 mg HBTU and agitate for 2 min. Charge siRNA mixture from Step 1. The reaction was not complete so repeated with half of previous reagent charge. Evaporated the reaction mixture, dialyzed and HPLC purified (X-Bridge Phenyl, TEAA/ACN gradient). Evaporated, dialyze and lyophilized to afford Conjugate 50.

Synthesis of Conjugate 51 (Ex. 145)

Dissolve GS (Conjugate 50) 10.65 mg in 1 ml water and dissolve PS (Conjugate 49) 10.20 mg in 1.17 ml water. Added 8.7 mg of Conjugate 49 to all of Conjugate 50 to form a 1:1 duplex. Heat to 90° C. for 1 min, cool to RT over 15 min. The solution was filtered and dried via lyophilizaiton to afford Conjugate 51 as a white solid.

RNA Silencing Activity of Compounds Transfected with Lipofectamine in Luciferase Constructs HEK293 cells stably transfected with luciferase vector that contains target sites for siRNA in 3'UTR of renilla luciferase were generated. These cells were seeded on 96-well tissue culture plates (Corning: #3903) at a density of 7.5e3 cells per well in DMEM 10% serum media. Cellular plates were then incubated at 37° C./5% CO2 for 24 hr. After incubation, plates were treated with test compounds co-transfected with transfection reagent Lipofectamine 2000 (invitrogen: #11668-019) in Opti-MEM (Gibco: #31985) in accordance to manufacturers protocol. The treatment concentrations ranged from 10 nM to 0.03 pM. Treated plates were then incubated for 24 hr at 37° C./5% CO2. Following treatment incubation, cells were lysed and processed in accordance to Dual-Glo™ Luciferase Assay (Promega: E2920) and read on a TECAN safire2 plate reader.

RNA Silencing Activity of Compounds Transfected with Lipofectamine in HepG2 Cells HepG2 cells (ATCC: HB-8065) were seeded on collagen coated plates (BioCoat: 356649) at a density of 7.5e3 cells per well in DMEM 10% serum media. Cellular plates were then incubated at 37° C./5% CO2 for 24 hr. After incubation, plates were treated with test compounds co-transfected with transfection reagent Lipofectamine 2000 (invitrogen: 11668-019) in Opti-MEM (Gibco: 31985) in accordance to invitrogen protocol. The treatment concentrations ranged from 10 nM to 0.03 pM. Treated plates were then incubated for 24 hr at 37° C./5% CO2. Following treatment incubation, cells were lysed with PLA Buffer (AB: 4448542) in accordance to supplied protocol. Resulting cell lysate was reverse transcribed to cDNA using High Capacity cDNA Kit (AB: 4368813) and run through qPCR using Life Technology 7900.

In Vivo Evaluation of RNAi Activity

CD1 female mice were dosed by subcutaneous injection in 200 ul volume. Animals were observed for behavioral or physiological changes. Animals were sacrificed 72 hrs post dose by CO2 asphyxiation followed by ex-sanguination via cardiac puncture. The liver samples were as 3 mm punches from the medial lobe and put into RNAlater tubes for isolation of total RNA. The mRNA knockdown analysis was conducted by Taqman analysis using standard procedures.

Scheme 43. General Description for Illustrative Purposes of Nomenclature Used in Table 6 as shown in FIG. 40. Exact siRNA sequences used in Table 6 can be found in Table 5.

A summary of in vitro and in vivo data of selected Compounds/Conjugates is shown in Table 6 and Table 7.

TABLE 6

In vitro and In Vivo Activity for Compounds Described in Section B-D.

| Compound # | RBC Hemolysis Data on Free Peptide | | % KD 2.5 mpk (SC admin) | % KD 5 mpk (iv admin) | 2.5 mpk (iv admin) |
|---|---|---|---|---|---|
| | EC 50 pH 7.4 (uM) | EC 50 pH 5.5 (uM) | | | |
| B8-seq137-b | 8.3 | 4.3 | | | 47 |
| B8-seq470-b | 8.5 | 3.8 | | | 57 |
| B8-seq1678-b | >20 | 5 | | | 49 |
| B8-seq 92-b | 0.3 | 0.3 | | | 57 |
| B8-seq1677-b | 10 | 0.4 | | | 57 |
| B8-seq-463-b | 18 | 9.8 | | | 61 |
| B8-seq1675-b | 7 | 4.5 | | | 47 |
| B11-seq1-b | 5.3 | 0.7 | | | 49 |
| B11-seq2-b | >10 | 1.2 | | | 32 |
| B11-seq3-b | >10 | 0.5 | | | 49 |
| B11-seq4-b | 4.3 | 0.2 | | | 55 |
| B11-seq5-b | 5 | 0.5 | | 74 | |
| B11-seq6-b | >10 | 1 | | 53 | |
| B11-seq7-b | >10 | 0.7 | | 45 | |
| B11-seq8-b | | | | | 22 |
| B11-seq9-b | 8.9 | 1.7 | | | 28 |
| B11-seq10-b | 6 | 1.8 | | | 35 |
| B11-seq11-b | 0.39 | 0.04 | | | 21 |
| B11-seq12-b | 2 | 0.2 | | | 45 |
| B11-seq13-b | 1.9 | 0.2 | 5 | | 64 |
| B11-seq14-b | 2.27 | 1.61 | | | 26 |
| B11-seq15-b | >10 | 0.4 | | | 28 |
| B11-seq16-b | 2.8 | 0.6 | | | 26 |
| B11-seq17-b | 4.4 | 0.7 | | | 34 |
| B11-seq18-b | 1 | 0.4 | | | 61 |
| B11-seq19-b | >10 | 0.7 | | | 64 |
| B11-seq20-b | 3.7 | 2.05 | | | 63 |
| B11-seq21-b | 2.2 | 0.4 | | | 56 |
| B11-seq22-b | 6 | 0.5 | | | 33 |
| B11-seq23-b | 7.3 | 6.1 | | | 59 |
| B11-seq24-b | >10 | 0.2 | | | 58 |
| B11-seq25-b | >10 | 3.6 | | | 52 |
| B11-seq26-b | 4.6 | 1.4 | 38 | 65 | 57 |
| B11-seq27-b | >10 | 0.4 | | | 61 |
| B11-seq28-b | 0.7 | 0.1 | | | 25 |
| B11-seq29-b | >10 | 2 | | | 20 |
| B11-seq30-b | >10 | 1.5 | | | 29 |
| B11-seq31-b | 1.5 | 0.3 | | | 64 |
| B11-seq32-b | 4.5 | 1.4 | | | 58 |
| B11-seq33-b | 0.02 | 0.04 | | | 35 |
| B11-seq34-b | 0.12 | 0.05 | | | 30 |
| B11-seq35-b | 0.03 | 0.03 | | | 37 |
| B11-seq36-b | 7.5 | 2.5 | | | 53 |
| B11-seq37-b | 6 | 2 | | | 22 |
| B11-seq38-b | 0.95 | 0.44 | | | 61 |
| B11-seq39-b | 1 | 0.6 | | | 58 |
| B11-seq40-b | 0.2 | 0.2 | | | 63 |
| B11-seq41-b | >10 | 0.7 | 36 | | 27 |
| B11-seq42-b | 1.3 | 1.9 | 41 | | 57 |
| B11-seq43-b | 0.9 | 0.3 | | | 55 |
| B11-seq44-b | 2.1 | 1.4 | 33 | | 56 |
| B11-seq45-b | >10 | 0.07 | 51 | | 53 |
| B11-seq46-b | 1.1 | 0.04 | 56 | | 46 |
| B11-seq47-b | >10 | 0.4 | 49 | | 51 |
| B11-seq48-b | 3.1 | 1.5 | 47 | | 61 |
| B11-seq49-b | 4 | 0.6 | 37 | | 49 |

TABLE 6-continued

In vitro and In Vivo Activity for Compounds Described in Section B-D.

| Compound # | RBC Hemolysis Data on Free Peptide | | % KD 2.5 mpk (SC admin) | % KD 5 mpk (iv admin) | % KD 2.5 mpk (iv admin) |
|---|---|---|---|---|---|
| | EC 50 pH 7.4 (uM) | EC 50 pH 5.5 (uM) | | | |
| B11-seq50-b | >10 | 1.9 | 10 | | 43 |
| B11-seq51-b | | | 11 | | 48 |
| B11-seq52-b | >10 | 6.4 | 14 | | 59 |
| B11-seq53-b | 1.17 | 0.37 | | | 45 |
| B11-seq54-b | 0.89 | 0.38 | | | 49 |
| B11-seq55-b | 0.51 | 0.18 | −7 | | 47 |
| B11-seq56-b | 1.46 | 0.19 | 12 | | 48 |
| B11-seq57-b | 3.5 | 0.59 | −11 | | |
| B11-seq58-b | 14.47 | 0.31 | 18 | | |
| B11-seq59-b | >20 | 0.65 | 7 | | 52 |
| B11-seq60-b | 19.57 | 0.38 | | | 39 |
| B11-seq61-b | 1.39 | 0.65 | | | 55 |
| B11-seq62-b | >20 | 5.86 | | | 52 |
| B11-seq63-b | 0.94 | 0.64 | | | 37 |
| B11-seq64-b | >20 | 1.8 | | | 41 |
| B11-seq65-b | 1.38 | 1.87 | | | 28 |
| B11-seq66-b | >20 | 0.82 | | | 54 |
| B11-seq67-b | >20 | 0.87 | | | 39 |
| B11-seq68-b | >20 | 5.05 | | | 56 |
| B11-seq69-b | >20 | 0.91 | | | 34 |
| B11-seq70-b | 3.68 | 1.86 | | | 32 |
| B11-seq71-b | >20 | 3.56 | | | 44 |
| B11-seq72-b | 10.63 | 2.54 | | | 39 |
| B11-seq73-b | >20 | 4.2 | | | 38 |
| B11-seq74-b | 12.68 | 4.34 | | | 60 |
| B11-seq75-b | >10 | 0.9 | | | 55 |
| B11-seq76-b | 6.4 | 1.7 | 3 | | 53 |
| B11-seq77-b | 0.17 | 0.23 | | | 38 |
| B11-seq78-b | 0.2 | 0.33 | | | 47 |
| B11-seq79-b | 1.52 | 1.86 | | | 47 |
| B11-seq80-b | >20 | 6.24 | | | 56 |
| B11-seq81-b | >20 | 3.91 | | | 51 |
| B11-seq82-b | 17 | 1.79 | | | 40 |
| B11-seq83-b | >20 | 6.19 | | | 35 |
| B11-seq84-b | 0.7 | 0.15 | | | 44 |
| B11-seq85-b | >10 | 0.1 | | | 45 |
| B11-seq86-b | >20 | 17.81 | | | 27 |
| B11-seq87-b | >10 | 0.02 | | | 30 |
| B11-seq88-b | 2.35 | 0.07 | | | 56 |
| B11-seq89-b | 3.29 | 0.14 | | | 51 |
| B11-seq90-b | >10 | 0.5 | | | 42 |
| B11-seq91-b | | | | | 26 |
| B11-seq92-b | | | | | 59 |
| B11-seq93-b | >20 | 5.88 | | | 51 |
| B11-seq94-b | 5.2 | 1.61 | | | 46 |
| B11-seq95-b | 3.59 | 3.1 | | | 43 |
| B11-seq96-b | 16.08 | 4.9 | | | 55 |
| B11-seq97-b | >20 | 5.56 | | | 52 |
| B11-seq98-b | >20 | 3.37 | | | 40 |
| B11-seq99-b | 12.9 | 5.61 | | | 43 |
| B11-seq100-b | 10.24 | 3.45 | | | 43 |
| B11-seq101-b | >20 | 4.85 | | | 46 |
| B11-seq102-b | >20 | 4.87 | | | 54 |
| B11-seq103-b | >20 | 3.86 | | | 43 |
| B11-seq104-b | 6.72 | 3.26 | | | 56 |
| B11-seq105-b | >10 | >10 | | | 30 |
| B11-seq106-b | 8.4 | 0.24 | | | 34 |
| B11-seq107-b | 10.41 | 3.52 | | | 41 |
| B11-seq108-b | 5.6 | 2.69 | | | 40 |
| B11-seq109-b | >20 | 5.78 | | | 36 |
| B11-seq110-b | >20 | 3.36 | | | 43 |
| B11-seq111-b | >20 | 0.26 | | | 36 |
| B11-seq371-b | >20 | 2.8 | | | 45 |
| B11-seq-1675-b | 14.2 | 3.5 | | | 53 |
| B13-seq 1676-b | 14.2 | 3.5 | | | 53 |
| B8-seq32-c | 4.5 | 1.4 | | | |
| C6-seq-31c | 1.5 | 0.3 | | 31 | |
| C6-seq32-c | 4.5 | 1.4 | | 36 | |
| C6-seq106-c | 7 | 0.7 | | 30 | |
| C12-seq32-c | 4.5 | 1.4 | | 68 | |
| C15-seq32-c | 4.5 | 1.4 | | 39 | |

TABLE 6-continued

In vitro and In Vivo Activity for Compounds Described in Section B-D.

| Compound # | RBC Hemolysis Data on Free Peptide | | | | % KD 2.5 mpk (iv admin) |
|---|---|---|---|---|---|
| | EC 50 pH 7.4 (uM) | EC 50 pH 5.5 (uM) | % KD 2.5 mpk (SC admin) | % KD 5 mpk (iv admin) | |
| D7-seq32-d | 4.5 | 1.4 | | | 52 |
| E10-seq 137-b | >20 | 3.3 | | | |
| F6-seq 26-f | >20 | >20 | | | 47 |
| F6-seq32-f | 4.5 | 1.4 | | | 47 |
| F6-seq463-f | 18 | 9.8 | | | 60 |
| F6-seq491-f | >20 | 3.3 | | | 72 |
| F6-seq492-f | >20 | 6.3 | | | 66 |
| F6-seq-612-f | 19 | 6 | | | 59 |
| F6-seq1693-f | 17.1 | 0.6 | | | 38 |
| F6-seq1694-f | 15.6 | 4.4 | | | 43 |
| G5-seq463-g | 18 | 9.8 | | | 47 |
| G5-seq489-g | >20 | >20 | | | 48 |
| H7-seq8-h | 20 | 1.3 | 13 | | 25 |
| H7-seq26-h | 4.6 | 1.4 | | | 35 |
| H7-seq32-h | 4.5 | 1.4 | 20 | | 30 |
| H7-seq37-h | 6 | 2 | | | 39 |
| H10-seq26-h | 4.6 | 1.4 | | | 20 |
| H10-seq32-h | 4.5 | 1.4 | | | 33 |
| I10-seq-1680-f | >20 | 1.6 | | | 67 |
| I10-seq-1681-f | >20 | 1.4 | | | 66 |
| I10-seq-1682-f | >20 | 1.6 | | | 66 |
| K6-seq37-h | 6 | 2 | | | 55 |
| K6-seq-74-h | 12.7 | 4.3 | | | 48 |
| K6-seq463-h | 18 | 9.8 | | | 55 |
| L11-seq 463j | 18 | 9.8 | | | 52 |
| M4-seq463-j | 18 | 9.8 | | | 52 |
| N4-seq106-k | 7 | 0.7 | | 69 | |
| N4-seq197-k | >20 | >20 | | 63 | |
| N4-seq283-k | >20 | >20 | | 64 | |
| O3-seq-463-k | 18 | 9.8 | 35 | | 70 |
| P2-seq32-k | 4.5 | 1.4 | | | 61 |
| P2-seq32-m | 4.5 | 1.4 | | | 64 |
| Q3-seq 32-b | 4.5 | 1.4 | | | 45 |
| Q3-seq 74-b | 12.7 | 4.3 | | | 43 |
| Q3-seq 1675-b | 14.2 | 3.5 | | | 70 |
| R4-seq1690-I | 1.9 | 0.6 | | | 79 |
| R4-seq1691-I | 1.6 | 0.5 | | | 55 |
| R4-seq1692-I | >20 | >20 | | | 72 |
| R4-seq1695-I | 14.2 | 0.3 | | | 79 |
| R4-seq1696-I | >20 | >20 | | | 36 |

TABLE 7

In vitro and In Vivo Activity for Compounds Generated in Section E. (Starting siRNA sequence information can be found in Table 8).

| Entry | Compound | Starting siRNA sequence code | Dose (mpk) Route of Administration | In vivo % KD (72 h) | IC50 w/LF2K in HEK-Luc [pM] | ASGR binding IC50 nM |
|---|---|---|---|---|---|---|
| 1 | 10a-1 | 51 | 5, 15 SC | 33.6; 69.5 | 15.44 | 36.7 |
| 2 | 10b-1 | 54 | SC 5, 15; IV 15 | 42, 49, 13 | 19.64 | 18.1 |
| 3 | 10-2 | 56 | 5, 50 SC | 40, 56 (24 h) | 23.4 | |
| 4 | 10-3 | 57 | 1, 2.5, 5 SC | 20, 45, 60 | 52 (HepG2) | |
| 5 | 17a-1 | 51 | 5 SC; 15 IV | 11, 5 | 20.16 | 49.1 |
| 6 | 17b-1 | 54 | 5 SC; 15 IV | 12, 22 | 43.96 | 33.3 |
| 7 | 19-1 | 52 | 5; 15 SC | 32; 68 | 24.04 | 3.6 |
| 8 | 29 | 53 | 15 SC; 15 IV | 43, 0 | 17.83 | 22 |
| 9 | 36 | 58 | 1, 2.5, 5 SC | 16, 43, 56 | | |
| 10 | 37 | 58 | 1, 2.5, 5 SC | 16, 32, 40 | | |
| 11 | 38 | 51 | 5 SC, 15 IV | 36, 33 | 71 | 17 |
| 12 | 39 | 51 | 5 SC, 15 IV | 19, 31 | 46.8 | 44 |
| 13 | 40 | 51 | 5, 15 SC | 33, 62 | 76.8 | 77 |
| 14 | 41 | 51 | 5, 15 SC | 28, 74 | 98.6 | 134 |
| 15 | 42 | 51 | 5, 15 SC | 19, 73 | 309.7 | 135 |
| 16 | 43 | 51 | 5, 15 SC | 8, 73 | 64.8 | 45 |
| 17 | 44 | 51 | 5, 15 SC | 31, 73 | 67.1 | 66 |
| 18 | 45 | 51 | 5 SC, 15 IV | 20, 4 | 73.4 | 11 |
| 19 | 48a-1 | 51 | 5, 15 SC | 10.24; 59.93 | 23.43 | |
| 20 | 48b-1 | 53 | 5, 15 SC | 19.87; 42.08 | 57.96 | |
| 21 | 51 | 55 | 5; 15 | 40; 45 | 1838.47 | 94.8 |

TABLE 8

Starting siRNA sequence information used to prepare conjugates from Table 7.

| Entry | Gene Target | Strand | Sequence | Duplex Code | SEQID NO: |
|---|---|---|---|---|---|
| 1 | ApoB | Passenger | [6amiL][iB][omeC][omeU][omeU][omeU][omeU][fluA][fluA][omeC][fluA][fluA][omeU][omeU][omeC][omeC][omeU][fluG][fluA][fluA][fluA][omeU][dTs]dT[iB] | 51 | 1721 |
| | ApoB | Guide | [rAs][rUs][rUs][omeU][omeC][fluA][fluG][fluG][fluA][fluA][omeU][omeU][fluG][fluU][omeU][omeU][fluA][fluA][fluA][fluG][omeUs][omeU] | | 1722 |
| 2 | ApoB | Passenger | [6amiL][iB][omeC][omeU][omeU][omeU][omeU][fluA][fluA][omeC][fluA][fluA][omeU][omeU][omeC][omeC][omeU][fluG][fluA][fluA][fluA][omeU][dTs]dT[iB][6amiL] | 52 | 1723 |
| | ApoB | Guide | [rAs][rUs][rUs][omeU][omeC][fluA][fluG][fluG][fluA][fluA][omeU][omeU][fluG][fluU][omeU][omeU][fluA][fluA][fluA][fluG][omeUs][omeU] | | 1724 |

TABLE 8-continued

Starting siRNA sequence information used to prepare conjugates from Table 7.

| Entry | Gene Target | Strand | Sequence | Duplex Code | SEQ ID NO: |
|---|---|---|---|---|---|
| 3 | ApoB | Passenger | [6amiL][iB][omeC][omeU][clickU][omeU][fluA][fluA][omeC][fluA][fluA][omeU][omeU][omeC][omeC][omeU][fluG][fluA][clickA][fluA][omeU][dTs]dT[iB][C6SH] | 53 | 1725 |
|  | ApoB | Guide | [rAs][rUs][rUs][omeU][omeC][fluA][fluG][fluG][fluA][fluA][omeU][omeU][fluG][fluU][omeU][fluA][fluA][fluA][fluG][omeUs][omeU] |  | 1726 |
| 4 | ApoB | Passenger | [iB][omeC][omeU][omeU][omeU][fluA][fluA][omeC][fluA][fluA][omeU][omeU][omeC][omeC][omeU][fluG][fluA][fluA][fluA][omeU][dTs]dT[iB][6amiL] | 54 | 1727 |
|  | ApoB | Guide | [rAs][rUs][rUs][omeU][omeC][fluA][fluG][fluG][fluA][fluA][omeU][omeU][fluG][fluU][omeU][fluA][fluA][fluA][fluG][omeUs][omeU] |  | 1728 |
| 5 | ApoB | Passenger | [6amiL][iB][omeC][omeU][omeU][omeU][fluA][fluA][omeC][fluA][fluA][omeU][omeU][omeC][omeC][omeU][fluG][fluA][fluA][fluA][omeU][dTs]dT[iB] | 55 | 1729 |
|  | ApoB | Guide | [rAs][rUs][rUs][omeU][omeC][fluA][fluG][fluG][fluA][fluA][omeU][omeU][fluG][fluU][clickU][fluA][fluA][fluA][fluG][omeUs][omeU] |  | 1730 |
| 6 | SSB | Passenger | [6amiL][iB][fluA][omeC][fluA][fluA][omeC][fluA][fluG][fluA][omeC][omeU][omeU][omeU][fluA][fluA][omeU][fluG][omeU][fluA][fluA][dTs]dT[iB] | 56 | 1731 |
|  | SSB | Guide | [rUs][rUs][rAs][omeC][fluA][omeU][omeU][fluA][fluA][fluA][fluG][omeU][omeC][fluU][fluG][omeU][omeU][fluG][omeU][omeUs][omeU] |  | 1732 |
| 7 | CTNNB1 | Passenger | [6amiL][iB][omeC][omeU][clickG][omeU][omeU][fluG][fluG][fluA][omeU][omeU][fluG][fluA][omeU][omeU][omeC][fluG][clickA][fluA][fluA][omeUs][omeU][iB][C3SH] | 57 | 1733 |
|  | CTNNB1 | Guide | [omeUs][fluUs][omeUs][fluC][omeG][fluA][omeA][fluU][omeC][fluA][omeA][fluU][omeC][fluC][omeA][fluA][omeC][fluA][omeG][omeUs][omeU] |  | 1734 |
| 8 | CTNNB1 | Passenger | [6amiL][iB][omeC][omeU][clickG][omeU][omeU][fluG][fluG][fluA][omeU][omeU][fluG][fluA][omeU][omeU][omeC][fluG][clickA][fluA][fluA][omeUs][omeU][iB][C3SH] | 58 | 1735 |
|  | CTNNB1 | Guide | [omeUs][fluUs][omeUs][fluC][omeG][fluA][omeA][fluU][omeC][fluA][omeA][fluU][omeC][fluC][clickA][fluA][omeC][fluA][omeG][omeUs][omeU] |  | 1736 |

As used herein, ome = 2' methoxy; flu = 2' fluoro; click = 2' propagyl; iB = inverted abasic; "s" subscript = phosphorothioate; and r = 2' ribo; 6amil = n-hexylamino; C3SH = n-propylthiol; and C6SH = n-hexylthiol.

One skilled in the art would readily appreciate that the present invention is well adapted to carry out the objects and obtain the ends and advantages mentioned, as well as those inherent therein. The methods and compositions described herein, as presently representative of preferred embodiments, are exemplary and are not intended as limitations on the scope of the invention. Changes therein and other uses will occur to those skilled in the art, which are encompassed within the spirit of the invention, are defined by the scope of the claims.

SEQUENCE LISTING (1739 sequences)

SEQ ID NO: 1 - protein, 34 aa, Artificial Sequence
  Description of Artificial Sequence: Synthetic polypeptide
CGLFEAIEEFIENLWELLIDGWYGYGRKKRRQRR

SEQ ID NO: 2 - protein, 34 aa, Artificial Sequence
  Description of Artificial Sequence: Synthetic polypeptide
CGLFEAIEGFIENGWEGMIDGWYGYGHKKHHQHH

SEQ ID NO: 3 - protein, 34 aa, Artificial Sequence
  Description of Artificial Sequence: Synthetic polypeptide
  MOD_RES (2)..(2): b-Ala
CALFEAIEGFIENGWEGMIDGWYGYGRKKRRQRR

SEQ ID NO: 4 - protein, 34 aa, Artificial Sequence
  Description of Artificial Sequence: Synthetic polypeptide
CGLFEAIEGFIENGLKGLIDWWYGYGRKKRRQRR

SEQ ID NO: 5 - protein, 34 aa, Artificial Sequence
  Description of Artificial Sequence: Synthetic polypeptide
CGLFEAIEGFIEWGWEGMIDGWYGYGRKKRRQRR

SEQ ID NO: 6 - protein, 34 aa, Artificial Sequence
  Description of Artificial Sequence: Synthetic polypeptide
CRRQRRKKRGYGYWGDIMGEWGNEIFGEIAEFLG

SEQ ID NO: 7 - protein, 33 aa, Artificial Sequence
  Description of Artificial Sequence: Synthetic polypeptide
CGLFEAIEGFIENGWEGMIDGWYGYGRKKRRQR

SEQ ID NO: 8 - protein, 34 aa, Artificial Sequence
  Description of Artificial Sequence: Synthetic polypeptide
CYGRKKRRQRRGLFEAIEGFIENGWEGMIDGWYG

SEQ ID NO: 9 - protein, 20 aa, Artificial Sequence
  Description of Artificial Sequence: Synthetic peptide
CIFGAIAGFIKNILKGLIDG

SEQ ID NO: 10 - protein, 14 aa, Artificial Sequence
  Description of Artificial Sequence: Synthetic peptide
CIFGAIAGFIRNIW

SEQ ID NO: 11 - protein, 34 aa, Artificial Sequence
  Description of Artificial Sequence: Synthetic polypeptide
CGLFHALLHLLHSLWHGLLHAWYGYGHKKHHQHR

SEQ ID NO: 12 - protein, 34 aa, Artificial Sequence
  Description of Artificial Sequence: Synthetic polypeptide
CGLFEAIEGLIENGWEGMIDGWYGYGRKKRRQRR

SEQ ID NO: 13 - protein, 34 aa, Artificial Sequence
  Description of Artificial Sequence: Synthetic polypeptide
CGLFELIEGFIENGWEGMIDGWYGYGRKKRRQRR

SEQ ID NO: 14 - protein, 34 aa, Artificial Sequence
  Description of Artificial Sequence: Synthetic polypeptide
  MOD_RES (27)..(31): Ornithine
CGLFEAIEGFIENGWEGLIDGWYGYGXXXXXQRR

SEQ ID NO: 15 - protein, 34 aa, Artificial Sequence
  Description of Artificial Sequence: Synthetic polypeptide
CGLFGAIEGFIENGWEGLIDGWYGYGRKKRRQRR

SEQ ID NO: 16 - protein, 34 aa, Artificial Sequence
  Description of Artificial Sequence: Synthetic polypeptide
CGLFEAIEGFLENGWEGMIDGWYGYGRKKRRQRR

SEQ ID NO: 17 - protein, 34 aa, Artificial Sequence
  Description of Artificial Sequence: Synthetic polypeptide
CGLFEAIEGFIENGLEGMIDGWYGYGRKKRRQRR

SEQ ID NO: 18 - protein, 34 aa, Artificial Sequence
  Description of Artificial Sequence: Synthetic polypeptide
CGLFGAIEGFIENGWEGMIDGWYGYGRKKRRQRR

SEQ ID NO: 19 - protein, 34 aa, Artificial Sequence
  Description of Artificial Sequence: Synthetic polypeptide
  MOD_RES (18)..(18): Nle
CGLFEAIEGFIENGWEGLIDGWYGYGRKKRRQRR

SEQ ID NO: 20 - protein, 21 aa, Artificial Sequence
  Description of Artificial Sequence: Synthetic peptide
CGIFGAIAGFIKNIWKGLIDW

SEQ ID NO: 21 - protein, 34 aa, Artificial Sequence
  Description of Artificial Sequence: Synthetic polypeptide
CYGRKKRRQRRGLFEAIEGFIENGWKGLIDAWYG

SEQ ID NO: 22 - protein, 34 aa, Artificial Sequence
  Description of Artificial Sequence: Synthetic polypeptide
CGLLEALEGLLESLWEGLLEAWYGYGRKKRRQRR

SEQ ID NO: 23 - protein, 34 aa, Artificial Sequence
  Description of Artificial Sequence: Synthetic polypeptide
CGLFEAIEGFIENGWEGMIDNWYGYGRKKRRQRR

SEQ ID NO: 24 - protein, 44 aa, Artificial Sequence
  Description of Artificial Sequence: Synthetic polypeptide
CIFGAIAGFIKNIWEGLIEAWYGLHLLHHLLHHLHHLLHHLLHL

SEQ ID NO: 25 - protein, 21 aa, Artificial Sequence
  Description of Artificial Sequence: Synthetic peptide
CIFGAIAGFIKNIWEGLIDAF

SEQ ID NO: 26 - protein, 18 aa, Artificial Sequence
  Description of Artificial Sequence: Synthetic peptide
CIFGAIAGFIKNIWEGLI

SEQ ID NO: 27 - protein, 35 aa, Artificial Sequence
  Description of Artificial Sequence: Synthetic polypeptide
CGLFEAIEGFIENGWEGMIDGWYGYGRKKRRQRRK

SEQ ID NO: 28 - protein, 63 aa, Artificial Sequence
  Description of Artificial Sequence: Synthetic polypeptide
CGLFEAIAGFIEGGWPGLINGWYGYGRKKRRQRRLHLLHHLLHHLHHLLHHLLHLLHHLLHHL

SEQ ID NO: 29 - protein, 56 aa, Artificial Sequence
  Description of Artificial Sequence: Synthetic polypeptide
CGLFEAIEGFIENGWEGMIDGWYGGGGLHLLHHLLHHLHHLLHHLLHLLHHLLHHL

SEQ ID NO: 30 - protein, 45 aa, Artificial Sequence
  Description of Artificial Sequence: Synthetic polypeptide
CGLFEAIEGFIENGWEGMIDGWYGLHLLHHLLHHLHHLLHHLLHL

SEQ ID NO: 31 - protein, 31 aa, Artificial Sequence
  Description of Artificial Sequence: Synthetic polypeptide
CGLFEALLELLESLWELLLEAYGRKKRRQRR

SEQ ID NO: 32 - protein, 34 aa, Artificial Sequence
  Description of Artificial Sequence: Synthetic polypeptide
CGLFEAIEGFIENGWEGMIDGWYGYGRKKRRQRR

SEQ ID NO: 33 - protein, 34 aa, Artificial Sequence
  Description of Artificial Sequence: Synthetic polypeptide
CGLFEAIEGFIENGWEGMADGWYGYGRKKRRQRR

SEQ ID NO: 34 - protein, 34 aa, Artificial Sequence
  Description of Artificial Sequence: Synthetic polypeptide
CGIFGAIAGFIKNIWEGLIDWWYGYGRKKRRQRR

SEQ ID NO: 35 - protein, 34 aa, Artificial Sequence
  Description of Artificial Sequence: Synthetic polypeptide
CGFLPAIAGILSQLFEGLIDGWYGYGRKKRRQRR

SEQ ID NO: 36 - protein, 14 aa, Artificial Sequence
  Description of Artificial Sequence: Synthetic peptide
CFFGAIWGFIKSIL

SEQ ID NO: 37 - protein, 23 aa, Artificial Sequence
  Description of Artificial Sequence: Synthetic peptide
CIFGAIAGFIKNIWKGLIDWWYG

SEQ ID NO: 38 - protein, 34 aa, Artificial Sequence
  Description of Artificial Sequence: Synthetic polypeptide
CGLFEAIEGFIWNGWEGMIDGWYGYGRKKRRQRR

SEQ ID NO: 39 - protein, 34 aa, Artificial Sequence
  Description of Artificial Sequence: Synthetic polypeptide
CGLFEAIAEFIENGWEGMIDGWYGYGRKKRRQRR

SEQ ID NO: 40 - protein, 34 aa, Artificial Sequence
  Description of Artificial Sequence: Synthetic polypeptide
CYGRKKRRQRRGLFEAIEGFIENGWKGLIDWWYG

SEQ ID NO: 41 - protein, 34 aa, Artificial Sequence
  Description of Artificial Sequence: Synthetic polypeptide
CGLFEAIEGFIEEGWEGMIDGWYGYGRKKRRQRR

SEQ ID NO: 42 - protein, 34 aa, Artificial Sequence
  Description of Artificial Sequence: Synthetic polypeptide
CGLFEAIEGFIENAWEGMIDGWYGYGRKKRRQRR

SEQ ID NO: 43 - protein, 34 aa, Artificial Sequence
  Description of Artificial Sequence: Synthetic polypeptide
CGLFEAIEGFIENGWEGMIDLWYGYGRKKRRQRR

SEQ ID NO: 44 - protein, 19 aa, Artificial Sequence
  Description of Artificial Sequence: Synthetic peptide
CRLLRLLLRLWRRLLRLLR

SEQ ID NO: 45 - protein, 34 aa, Artificial Sequence
  Description of Artificial Sequence: Synthetic polypeptide
CGGFEAIEGFIENGWEGMIDGWYGYGRKKRRQRR

SEQ ID NO: 46 - protein, 34 aa, Artificial Sequence
  Description of Artificial Sequence: Synthetic polypeptide
CGLFEKIEGFIENGWEGMIDGWYGYGRKKRRQRR

SEQ ID NO: 47 - protein, 34 aa, Artificial Sequence
  Description of Artificial Sequence: Synthetic polypeptide
CGLFEAIEGFIENGWENMIDGWYGYGRKKRRQRR

SEQ ID NO: 48 - protein, 17 aa, Artificial Sequence
  Description of Artificial Sequence: Synthetic peptide
CIFGAIAGFIKNILKGL

SEQ ID NO: 49 - protein, 23 aa, Artificial Sequence
  Description of Artificial Sequence: Synthetic peptide
CIFGAIAGFIKNILKGLIDGWYG

SEQ ID NO: 50 - protein, 34 aa, Artificial Sequence; identical to SEQ ID NO: 32
  Description of Artificial Sequence: Synthetic polypeptide
  misc_feature (24)..(25): Residues at these positions separated by a (PEG)3 moiety

SEQ ID NO: 51 - protein, 52 aa, Artificial Sequence
  Description of Artificial Sequence: Synthetic polypeptide
CGLFEALLELLESLWELLLEAYGRKKRRQRRLHLLHHLLHHLHHLLHHLLHL

SEQ ID NO: 52 - protein, 41 aa, Artificial Sequence
  Description of Artificial Sequence: Synthetic polypeptide
CYGRKKRRQRRWEAALAEALAEALAEHLAEALAEALEALAA

SEQ ID NO: 53 - protein, 41 aa, Artificial Sequence
  Description of Artificial Sequence: Synthetic polypeptide
CIFGAIAGFIKNIWEGLIDGWYGKLALKLALKALKAALKLA

SEQ ID NO: 54 - protein, 33 aa, Artificial Sequence
  Description of Artificial Sequence: Synthetic polypeptide
CFFGAIWEFIRSILEGLIDGWYGYGRKKRRQRR

SEQ ID NO: 55 - protein, 34 aa, Artificial Sequence
  Description of Artificial Sequence: Synthetic polypeptide
CGLFHALLHLLHSLWHLLLHAWYGYGRKKRRQRR

SEQ ID NO: 56 - protein, 34 aa, Artificial Sequence
  Description of Artificial Sequence: Synthetic polypeptide
CGLFHALLHLLHSLWHLLLHAWYGYGHKKHHQHR

SEQ ID NO: 57 - protein, 31 aa, Artificial Sequence
  Description of Artificial Sequence: Synthetic polypeptide
CGLFGALLELLESLWKGLLEWYGRKKRRQRR

SEQ ID NO: 58 - protein, 34 aa, Artificial Sequence
  Description of Artificial Sequence: Synthetic polypeptide
CRRQRRKKRGYGYWGDILGEWGNEIFGEIAEFLG

SEQ ID NO: 59 - protein, 34 aa, Artificial Sequence
  Description of Artificial Sequence: Synthetic polypeptide
  MOD_RES (28)..(29): Ornithine
CGLFEALEGFLENGWEGLLDGWYGYGRXXRRQRR

SEQ ID NO: 60 - protein, 34 aa, Artificial Sequence
  Description of Artificial Sequence: Synthetic polypeptide
CGLFGEIEELIENGLKNLIDWWYGYGRKKRRQRR

SEQ ID NO: 61 - protein, 34 aa, Artificial Sequence
  Description of Artificial Sequence: Synthetic polypeptide
  MOD_RES (1)..(34): D-amino acid
CRRQRRKKRGYGYWWDILGKWGNEIFGEIAEFLG

SEQ ID NO: 62 - protein, 15 aa, Artificial Sequence
  Description of Artificial Sequence: Synthetic peptide
CGIFGAIAGFIKNIL

SEQ ID NO: 63 - protein, 16 aa, Artificial Sequence
  Description of Artificial Sequence: Synthetic peptide
CGIFGAIAGLLKNIFK

SEQ ID NO: 64 - protein, 20 aa, Artificial Sequence
  Description of Artificial Sequence: Synthetic peptide
CIFGAIAGFIKNIWKGLIDW

SEQ ID NO: 65 - protein, 15 aa, Artificial Sequence
  Description of Artificial Sequence: Synthetic peptide
CIFGAIAGFIKNIWK

SEQ ID NO: 66 - protein, 34 aa, Artificial Sequence
  Description of Artificial Sequence: Synthetic polypeptide
CGLFEEIEGFIENGWEGLIDWWYGYGHKKHHQHR

SEQ ID NO: 67 - protein, 34 aa, Artificial Sequence
  Description of Artificial Sequence: Synthetic polypeptide
CGLFGEIEELIENGLKNLIDWWYGYGHKKHHQHR

SEQ ID NO: 68 - protein, 34 aa, Artificial Sequence
  Description of Artificial Sequence: Synthetic polypeptide
CGLFEEIEEFIENGWEGLIDWWYGYGHKKHHQHR

SEQ ID NO: 69 - protein, 41 aa, Artificial Sequence
  Description of Artificial Sequence: Synthetic polypeptide
WEAALAEALAEALAEHLAEALAEALEALAAYGRKKRRQRRC

SEQ ID NO: 70 - protein, 47 aa, Artificial Sequence
  Description of Artificial Sequence: Synthetic polypeptide
CGLFEAIEGFIENGWKGLIDGWYGGLFEAIEGFIENGWKGLIDWWYG

SEQ ID NO: 71 - protein, 21 aa, Artificial Sequence
  Description of Artificial Sequence: Synthetic peptide
CGFFHAFFHFFHSFWHGFFEA

SEQ ID NO: 72 - protein, 24 aa, Artificial Sequence
  Description of Artificial Sequence: Synthetic peptide
CGNFGEIEELIEEGLENLIDWWNG

SEQ ID NO: 73 - protein, 17 aa, Artificial Sequence
  Description of Artificial Sequence: Synthetic peptide
CFFGAIWEFIRNILEGF

SEQ ID NO: 74 - protein, 14 aa, Artificial Sequence
  Description of Artificial Sequence: Synthetic peptide
CFFGAIWEFIHSIL

SEQ ID NO: 75 - protein, 21 aa, Artificial Sequence
  Description of Artificial Sequence: Synthetic peptide
CGLFHALLHLLHSLWHGLLEA

SEQ ID NO: 76 - protein, 17 aa, Artificial Sequence
  Description of Artificial Sequence: Synthetic peptide
CIFGAIAGFIKNIWEGL

SEQ ID NO: 77 - protein, 33 aa, Artificial Sequence
  Description of Artificial Sequence: Synthetic polypeptide
CIFGAIAGLLKNIFEGLIDGWYGYGRKKRRQRR

SEQ ID NO: 78 - protein, 34 aa, Artificial Sequence
  Description of Artificial Sequence: Synthetic polypeptide
CGFIGAIANLLSKIFEGLIDGWYGYGRKKRRQRR

SEQ ID NO: 79 - protein, 34 aa, Artificial Sequence
  Description of Artificial Sequence: Synthetic polypeptide
CGLFEAIEELIENLWKGLIDAWYGYGRKKRRQRR

SEQ ID NO: 80 - protein, 21 aa, Artificial Sequence
  Description of Artificial Sequence: Synthetic peptide
CGIFGAIAGLLKNIFKGLIDA

SEQ ID NO: 81 - protein, 21 aa, Artificial Sequence
  Description of Artificial Sequence: Synthetic peptide
CGIFGAIAGLLKNIFKGLIDW

SEQ ID NO: 82 - protein, 16 aa, Artificial Sequence
  Description of Artificial Sequence: Synthetic peptide
CGIFEAIAGLLKNIFK

SEQ ID NO: 83 - protein, 16 aa, Artificial Sequence
  Description of Artificial Sequence: Synthetic peptide
CGIFEEIAGLLKNIFK

SEQ ID NO: 84 - protein, 55 aa, Artificial Sequence
  Description of Artificial Sequence: Synthetic polypeptide
CGLFEAIAGFIEGGWPGLINGWYGYGRKKRRQRRLHLLHHLLHHLHHLLHHLLHL

SEQ ID NO: 85 - protein, 35 aa, Artificial Sequence
  Description of Artificial Sequence: Synthetic polypeptide
CGLFEAIEGFIENGWKGMIDWWYGYGRKKRRQRRK

SEQ ID NO: 86 - protein, 24 aa, Artificial Sequence
  Description of Artificial Sequence: Synthetic peptide
CGLFGEIEEFIENGWKGLIDWWYG

SEQ ID NO: 87 - protein, 35 aa, Artificial Sequence
  Description of Artificial Sequence: Synthetic polypeptide
CIFGAIAGFIKNIWLHLLHHLLHHLHHLLHHLLHL

SEQ ID NO: 88 - protein, 33 aa, Artificial Sequence
  Description of Artificial Sequence: Synthetic polypeptide
CGIFGAIEGFIENGWKGLIDAWYGYRKKRRQRR

SEQ ID NO: 89 - protein, 34 aa, Artificial Sequence
  Description of Artificial Sequence: Synthetic polypeptide
CELFGAIEGFIENGWKGLIDWWYGYGRKKRRQRR

SEQ ID NO: 90 - protein, 39 aa, Artificial Sequence
  Description of Artificial Sequence: Synthetic polypeptide
CIFGIDDLIIGLLFVAIVEAGIGGYLLGSYGRKKRRQRR

SEQ ID NO: 91 - protein, 35 aa, Artificial Sequence
  Description of Artificial Sequence: Synthetic polypeptide
GLFGALAEALAEALAEHLAEALAEALEALAAGGSC

SEQ ID NO: 92 - protein, 34 aa, Artificial Sequence; identical to SEQ ID NO: 78
  Description of Artificial Sequence: Synthetic polypeptide
  MOD_RES (1)..(34): D-amino acid

SEQ ID NO: 93 - protein, 18 aa, Artificial Sequence
  Description of Artificial Sequence: Synthetic peptide
CFFGAIWEFIRSILKGLI

SEQ ID NO: 94 - protein, 15 aa, Artificial Sequence
  Description of Artificial Sequence: Synthetic peptide
CFFGAIWEFIRSILK

SEQ ID NO: 95 - protein, 15 aa, Artificial Sequence
  Description of Artificial Sequence: Synthetic peptide
CFFGAIWEFIRSILE

SEQ ID NO: 96 - protein, 15 aa, Artificial Sequence
  Description of Artificial Sequence: Synthetic peptide
CIFGAIAGFIKNIWE

SEQ ID NO: 97 - protein, 20 aa, Artificial Sequence
  Description of Artificial Sequence: Synthetic peptide
CIFGAIAGFIKNIWKGLIDA

SEQ ID NO: 98 - protein, 15 aa, Artificial Sequence
  Description of Artificial Sequence: Synthetic peptide
CFFEAIEEFIKNILK

SEQ ID NO: 99 - protein, 14 aa, Artificial Sequence
  Description of Artificial Sequence: Synthetic peptide
CIFGAIAGLLRNIF

SEQ ID NO: 100 - protein, 15 aa, Artificial Sequence
  Description of Artificial Sequence: Synthetic peptide
CGIFGAIAGLLKNIW

SEQ ID NO: 101 - protein, 14 aa, Artificial Sequence
  Description of Artificial Sequence: Synthetic peptide
CLFGAIWEFIKSIL

SEQ ID NO: 102 - protein, 14 aa, Artificial Sequence
  Description of Artificial Sequence: Synthetic peptide
CFWGAIWEFIKSIL

SEQ ID NO: 103 - protein, 14 aa, Artificial Sequence
  Description of Artificial Sequence: Synthetic peptide
CFGGAIWEFIKSIL

SEQ ID NO: 104 - protein, 14 aa, Artificial Sequence
  Description of Artificial Sequence: Synthetic peptide
CFAGAIWEFIKSIL

SEQ ID NO: 105 - protein, 34 aa, Artificial Sequence; identical to SEQ ID NO: 32
  Description of Artificial Sequence: Synthetic polypeptide

SEQ ID NO: 106 - protein, 34 aa, Artificial Sequence
  Description of Artificial Sequence: Synthetic polypeptide
CGLFEAIEGFIENGWEGMIDWWYGYGRKKRRQRR

SEQ ID NO: 107 - protein, 14 aa, Artificial Sequence
  Description of Artificial Sequence: Synthetic peptide
CFFGAIWEFIKSIG

SEQ ID NO: 108 - protein, 14 aa, Artificial Sequence
  Description of Artificial Sequence: Synthetic peptide
CFFGAIWEFIKSIA

SEQ ID NO: 109 - protein, 14 aa, Artificial Sequence
  Description of Artificial Sequence: Synthetic peptide
CFFGAIWEFIKSIN

SEQ ID NO: 110 - protein, 14 aa, Artificial Sequence
  Description of Artificial Sequence: Synthetic peptide
CFFGAIWEFIKSIW

SEQ ID NO: 111 - protein, 33 aa, Artificial Sequence
  Description of Artificial Sequence: Synthetic polypeptide
CFFGAIWEFIKSILEGLIDWWYGYGHKKHHQHR

SEQ ID NO: 112 - protein, 30 aa, Artificial Sequence
  Description of Artificial Sequence: Synthetic polypeptide
CLHLLHHLLHHLHHLLHHLLHLLHHLLHHL

SEQ ID NO: 113 - protein, 45 aa, Artificial Sequence
  Description of Artificial Sequence: Synthetic polypeptide
LHLLHHLLHHLHHLLHHLLHLLHHLLHHLGGGRKKRRQRRRPPQC

SEQ ID NO: 114 - protein, 45 aa, Artificial Sequence
  Description of Artificial Sequence: Synthetic polypeptide
CRKKRRQRRRPPQGGGLHLLHHLLHHLHHLLHHLLHLLHHLLHHL

SEQ ID NO: 115 - protein, 45 aa, Artificial Sequence
  Description of Artificial Sequence: Synthetic polypeptide
CLHLLHHLLHHLHHLLHHLLHLLHHLLHHLGGGRKKRRQRRRPPQ

SEQ ID NO: 116 - protein, 34 aa, Artificial Sequence
  Description of Artificial Sequence: Synthetic polypeptide
CGLFHAIAHFIHGGWHGLIHGWYGYGRKKRRQRR

SEQ ID NO: 117 - protein, 34 aa, Artificial Sequence
  Description of Artificial Sequence: Synthetic polypeptide
CGLFKAIAKFIKGGWKGLIKGWYGYGRKKRRQRR

SEQ ID NO: 118 - protein, 34 aa, Artificial Sequence
  Description of Artificial Sequence: Synthetic polypeptide
CGLFEAIAGFIENGWEGMIDGWYGYGRKKRRQRR

SEQ ID NO: 119 - protein, 41 aa, Artificial Sequence
  Description of Artificial Sequence: Synthetic polypeptide
CWEAALAEALAEALAEHLAEALAEALEALAAYGRKKRRQRR

SEQ ID NO: 120 - protein, 36 aa, Artificial Sequence
  Description of Artificial Sequence: Synthetic polypeptide
CGLFEAIEGFIENGWEGMIDGWYGRKKRRQRRRPPQ

SEQ ID NO: 121 - protein, 34 aa, Artificial Sequence
  Description of Artificial Sequence: Synthetic polypeptide
GLFEAIEGFIENGWEGMIDGWYGYGRKKRRQRRC

SEQ ID NO: 122 - protein, 41 aa, Artificial Sequence
  Description of Artificial Sequence: Synthetic polypeptide
LHLLHHLLHHLHHLLHHLLHLLHHLLHHLRKKRRQRRRPPQ

SEQ ID NO: 123 - protein, 44 aa, Artificial Sequence
  Description of Artificial Sequence: Synthetic polypeptide
LHLLHHLLHHLHHLLHHLLHLLHHLLHHLGPGRKKRRQRRRPPQ

SEQ ID NO: 124 - protein, 23 aa, Artificial Sequence
  Description of Artificial Sequence: Synthetic peptide
LIRLWSHLIHIWFQNRRLKWKKK

SEQ ID NO: 125 - protein, 17 aa, Artificial Sequence
  Description of Artificial Sequence: Synthetic peptide
RKKRRQRRRPPQQQQQQ

SEQ ID NO: 126 - protein, 33 aa, Artificial Sequence
  Description of Artificial Sequence: Synthetic polypeptide
GLFEAIEGFIENGWEGMIDGWYGYGRKKRRQRR

SEQ ID NO: 127 - protein, 41 aa, Artificial Sequence
  Description of Artificial Sequence: Synthetic polypeptide
LHLLHHLLHHLHHLLHHLLHLLHHLLHHLGGGRRRRRRRRR

SEQ ID NO: 128 - protein, 41 aa, Artificial Sequence; identical to SEQ ID NO: 122
  Description of Artificial Sequence: Synthetic polypeptide
  misc_feature (29)..(30): Residues at these positions separated by a (PEG)12 moiety

SEQ ID NO: 129 - protein, 44 aa, Artificial Sequence
  Description of Artificial Sequence: Synthetic polypeptide
GLFGAIAGFIENGWEGMIDGWYGLIRLWSHLIWFQNRRLKWLLL

SEQ ID NO: 130 - protein, 49 aa, Artificial Sequence
  Description of Artificial Sequence: Synthetic polypeptide
HHHHHRKKRRQRRRPPQGGGLHLLHHLLHHLHHLLHHLLHLLHHLLHHL

SEQ ID NO: 131 - protein, 41 aa, Artificial Sequence; identical to SEQ ID NO: 122
  Description of Artificial Sequence: Synthetic polypeptide
  misc_feature (29)..(30): Residues at these positions separated by a (PEG)2 moiety

SEQ ID NO: 132 - protein, 49 aa, Artificial Sequence
  Description of Artificial Sequence: Synthetic polypeptide
LHLLHHLLHHLHHLLHHLLLLHHLLHHLGGGRQIKIWFQNRRMKWKKGG

SEQ ID NO: 133 - protein, 36 aa, Artificial Sequence
  Description of Artificial Sequence: Synthetic polypeptide
KLLKLLLKLWLKLLKLLLKLLGGGRKKRRQRRRPPQ

SEQ ID NO: 134 - protein, 30 aa, Artificial Sequence
  Description of Artificial Sequence: Synthetic polypeptide
  MOD_RES (1)..(30): D-amino acid
LHHLLHHLLHLLHHLLHHLHHLLHHLLHLC

SEQ ID NO: 135 - protein, 42 aa, Artificial Sequence
  Description of Artificial Sequence: Synthetic polypeptide
  misc_feature (29)..(30): Residues at these positions separated by a (PEG)6 moiety
LHLLHHLLHHLHHLLHHLLHLLHHLLHHLRKKRRQRRRPPQC

SEQ ID NO: 136 - protein, 34 aa, Artificial Sequence; identical to SEQ ID NO: 121
  Description of Artificial Sequence: Synthetic polypeptide

SEQ ID NO: 137 - protein, 34 aa, Artificial Sequence; identical to SEQ ID NO: 32
  Description of Artificial Sequence: Synthetic polypeptide
  MOD_RES (1)..(34): D-amino acid

SEQ ID NO: 138 - protein, 35 aa, Artificial Sequence
  Description of Artificial Sequence: Synthetic polypeptide
CGLFEAIEGFIENGWEGMIDGWYGYGRRRRRRRRR

SEQ ID NO: 139 - protein, 34 aa, Artificial Sequence
  Description of Artificial Sequence: Synthetic polypeptide
YGRKKRRQRRGLFEAIEGFIENGWEGMIDGWYGC

SEQ ID NO: 140 - protein, 27 aa, Artificial Sequence
  Description of Artificial Sequence: Synthetic peptide
CGVFVLGFLGFLATAGSYGRKKRRQRR

SEQ ID NO: 141 - protein, 24 aa, Artificial Sequence
  Description of Artificial Sequence: Synthetic peptide
CGLFKAIAKFIKGGWKGLIKGWYG

SEQ ID NO: 142 - protein, 30 aa, Artificial Sequence
  Description of Artificial Sequence: Synthetic polypeptide
CGLFEAIEGFIENGWEGMIDGWYGYGRKKR

SEQ ID NO: 143 - protein, 44 aa, Artificial Sequence
  Description of Artificial Sequence: Synthetic polypeptide
CGLFEAIEGFIENGWEGMIDGWYGYGRKKRRQRRYGRKKRRQRR

SEQ ID NO: 144 - protein, 44 aa, Artificial Sequence; identical to SEQ ID NO: 143
  Description of Artificial Sequence: Synthetic polypeptide

SEQ ID NO: 145 - protein, 34 aa, Artificial Sequence
  Description of Artificial Sequence: Synthetic polypeptide
CGLFEAIKGFIENGWEGMIDGWYGYGRKKRRQRR

SEQ ID NO: 146 - protein, 34 aa, Artificial Sequence
  Description of Artificial Sequence: Synthetic polypeptide
CGLFEAIHGFIENGWEGMIDGWYGYGRKKRRQRR

SEQ ID NO: 147 - protein, 34 aa, Artificial Sequence
  Description of Artificial Sequence: Synthetic polypeptide
CGLFEAIRGFIENGWEGMIDGWYGYGRKKRRQRR

SEQ ID NO: 148 - protein, 34 aa, Artificial Sequence
  Description of Artificial Sequence: Synthetic polypeptide
CGLFEAIDGFIENGWEGMIDGWYGYGRKKRRQRR

SEQ ID NO: 149 - protein, 34 aa, Artificial Sequence
  Description of Artificial Sequence: Synthetic polypeptide
CRLFEAIEGFIENGWEGMIDGWYGYGRKKRRQRR

SEQ ID NO: 150 - protein, 36 aa, Artificial Sequence
  Description of Artificial Sequence: Synthetic polypeptide
CGGGLFEAIEGFIENGWEGMIDGWYGYGRKKRRQRR

SEQ ID NO: 151 - protein, 37 aa, Artificial Sequence
  Description of Artificial Sequence: Synthetic polypeptide
CGLFEAIEGFIENGWEGMIDGWYGGGGYGRKKRRQRR

SEQ ID NO: 152 - protein, 34 aa, Artificial Sequence; identical to SEQ ID NO: 32
  Description of Artificial Sequence: Synthetic polypeptide
  misc_feature (24)..(25): Residues at these positions separated by a (PEG)11 moiety

SEQ ID NO: 153 - protein, 25 aa, Artificial Sequence
  Description of Artificial Sequence: Synthetic peptide
CFLGFLLGVGSAIASGIAVSKVLHL

SEQ ID NO: 154 - protein, 38 aa, Artificial Sequence
  Description of Artificial Sequence: Synthetic polypeptide
CGVFVLGFLGFLATAGSAMGARSLTLSAYGRKKRRQRR

SEQ ID NO: 155 - protein, 20 aa, Artificial Sequence
  Description of Artificial Sequence: Synthetic peptide
GLWRALWRLLRSLWRLLWRA

SEQ ID NO: 156 - protein, 34 aa, Artificial Sequence
  Description of Artificial Sequence: Synthetic polypeptide
  MOD_RES (2)..(2): Nle
CLLFEAIEGFIENGWEGMIDGWYGYGRKKRRQRR

SEQ ID NO: 157 - protein, 34 aa, Artificial Sequence
  Description of Artificial Sequence: Synthetic polypeptide
CELFEAIEGFIENGWEGMIDGWYGYGRKKRRQRR

SEQ ID NO: 158 - protein, 34 aa, Artificial Sequence
  Description of Artificial Sequence: Synthetic polypeptide
CGFFGAIAGFLEGGWEGMIAGWHGYGRKKRRQRR

SEQ ID NO: 159 - protein, 35 aa, Artificial Sequence
  Description of Artificial Sequence: Synthetic polypeptide
CFLGFLLGVGSAIASGIAVSKVLHLYGRKKRRQRR

SEQ ID NO: 160 - protein, 34 aa, Artificial Sequence
  Description of Artificial Sequence: Synthetic polypeptide
GLFEAIEGFIENGWEGLAEALAEALEALAAGGSC

SEQ ID NO: 161 - protein, 53 aa, Artificial Sequence
  Description of Artificial Sequence: Synthetic polypeptide
CGLFEAIEGFIENGWEGMIDGWYGLHLLHHLLHHLHHLLHHLLHLLHHLLHHL

SEQ ID NO: 162 - protein, 63 aa, Artificial Sequence
  Description of Artificial Sequence: Synthetic polypeptide
CGLFEAIEGFIENGWEGMIDGWYGYGRKKRRQRRLHLLHHLLHHLHHLLHHLLHLLHHLLHHL

SEQ ID NO: 163 - protein, 34 aa, Artificial Sequence
  Description of Artificial Sequence: Synthetic polypeptide
CGLFGAIAGFIEGGWTGMIDGWYGYGRKKRRQRR

SEQ ID NO: 164 - protein, 34 aa, Artificial Sequence
  Description of Artificial Sequence: Synthetic polypeptide
CGLFGAIAGFIEGGWQGMVDGWYGYGRKKRRQRR

SEQ ID NO: 165 - protein, 34 aa, Artificial Sequence
  Description of Artificial Sequence: Synthetic polypeptide
CGLFGAIAGFIENGWQGLIDGWYGYGRKKRRQRR

SEQ ID NO: 166 - protein, 34 aa, Artificial Sequence
  Description of Artificial Sequence: Synthetic polypeptide
CGLFGAIAGFIENGWEGLVDGWYGYGRKKRRQRR

SEQ ID NO: 167 - protein, 34 aa, Artificial Sequence
  Description of Artificial Sequence: Synthetic polypeptide
CGLFGAIAGFIEGGWSGMIDGWYGYGRKKRRQRR

SEQ ID NO: 168 - protein, 34 aa, Artificial Sequence
  Description of Artificial Sequence: Synthetic polypeptide
CGLFGAIAGFIEGGWPGLVAGWYGYGRKKRRQRR

SEQ ID NO: 169 - protein, 34 aa, Artificial Sequence
  Description of Artificial Sequence: Synthetic polypeptide
CGLFGAIAGFIENGWEGMVDGWYGYGRKKRRQRR

SEQ ID NO: 170 - protein, 34 aa, Artificial Sequence
  Description of Artificial Sequence: Synthetic polypeptide
CGLFGAIAGFIEGGWPGLINGWYGYGRKKRRQRR

SEQ ID NO: 171 - protein, 34 aa, Artificial Sequence
  Description of Artificial Sequence: Synthetic polypeptide
CGLFGAIAGFIENGWEGLIDGWYGYGRKKRRQRR

SEQ ID NO: 172 - protein, 34 aa, Artificial Sequence
  Description of Artificial Sequence: Synthetic polypeptide
CGLFGAIAGFIENGWEGMIDGWYGYGRKKRRQRR

SEQ ID NO: 173 - protein, 30 aa, Artificial Sequence
  Description of Artificial Sequence: Synthetic polypeptide
CGLFGAIAGFIENGWEGMIDGWYGSSKKKK

SEQ ID NO: 174 - protein, 34 aa, Artificial Sequence; identical to SEQ ID NO: 171
  Description of Artificial Sequence: Synthetic polypeptide

SEQ ID NO: 175 - protein, 34 aa, Artificial Sequence; identical to SEQ ID NO: 19
  Description of Artificial Sequence: Synthetic polypeptide

SEQ ID NO: 176 - protein, 34 aa, Artificial Sequence
  Description of Artificial Sequence: Synthetic polypeptide
CGLFGAIAGFIENGWEGLIEGWYGGGRKKRRQRR

SEQ ID NO: 177 - protein, 34 aa, Artificial Sequence
  Description of Artificial Sequence: Synthetic polypeptide
CGLFEAIEGFIENGWEGMIDGWYGGGRKKRRQRR

SEQ ID NO: 178 - protein, 34 aa, Artificial Sequence
  Description of Artificial Sequence: Synthetic polypeptide
CGLFEAIAGFIENGWEGLIDGWYGYGRKKRRQRR

SEQ ID NO: 179 - protein, 33 aa, Artificial Sequence
  Description of Artificial Sequence: Synthetic polypeptide
CGLFEAIAEFIENGWEGLIEGWYGGRKKRRQRR

SEQ ID NO: 180 - protein, 33 aa, Artificial Sequence
  Description of Artificial Sequence: Synthetic polypeptide
CGLFEAIEGFIENGWEGMIDGWYGRKKRRQRRR

SEQ ID NO: 181 - protein, 22 aa, Artificial Sequence
  Description of Artificial Sequence: Synthetic peptide
CKLLKLLLKLWLKLLKLLLKLL

SEQ ID NO: 182 - protein, 32 aa, Artificial Sequence
  Description of Artificial Sequence: Synthetic polypeptide
CKLLKLLLKLWLKLLKLLLKLLYGRKKRRQRR

SEQ ID NO: 183 - protein, 24 aa, Artificial Sequence
  Description of Artificial Sequence: Synthetic peptide
GLFEAIEGFIENGWEGMIDGWYGC

SEQ ID NO: 184 - protein, 34 aa, Artificial Sequence
  Description of Artificial Sequence: Synthetic polypeptide
CVLFEAIEGFIENGWEGMIDGWYGYGRKKRRQRR

SEQ ID NO: 185 - protein, 34 aa, Artificial Sequence
  Description of Artificial Sequence: Synthetic polypeptide
CSLFEAIEGFIENGWEGMIDGWYGYGRKKRRQRR

SEQ ID NO: 186 - protein, 32 aa, Artificial Sequence
  Description of Artificial Sequence: Synthetic polypeptide
CGLFEAIEGFIENGWEGMIDGWYGYGRKKRRQ

SEQ ID NO: 187 - protein, 31 aa, Artificial Sequence
  Description of Artificial Sequence: Synthetic polypeptide
CGLFEAIEGFIENGWEGMIDGWYGYGRKKRR

SEQ ID NO: 188 - protein, 34 aa, Artificial Sequence
  Description of Artificial Sequence: Synthetic polypeptide
CGLFEAIEGFIENGWEGMIDGWYGYGKKKKKQKK

SEQ ID NO: 189 - protein, 47 aa, Artificial Sequence
  Description of Artificial Sequence: Synthetic polypeptide
CGLFEAIEGFIENGWEGMIDGWYGGLFEAIEGFIENGWEGMIDGWYG

SEQ ID NO: 190 - protein, 67 aa, Artificial Sequence
  Description of Artificial Sequence: Synthetic polypeptide
CGLFEAIEGFIENGWEGMIDGWYGYGRKKRRQRRGLFEAIEGFIENGWEGMIDGWYGYGRKKRRQRR

SEQ ID NO: 191 - protein, 34 aa, Artificial Sequence
  Description of Artificial Sequence: Synthetic polypeptide
RRQRRKKRGYGYWGDIMGEWGNEIFGEIAEFLGC

SEQ ID NO: 192 - protein, 34 aa, Artificial Sequence; identical to SEQ ID NO: 6
  Description of Artificial Sequence: Synthetic polypeptide

SEQ ID NO: 193 - protein, 33 aa, Artificial Sequence; identical to SEQ ID NO: 126
  Description of Artificial Sequence: Synthetic polypeptide
  MOD_RES (28)..(28): D-amino acid

SEQ ID NO: 194 - protein, 33 aa, Artificial Sequence; identical to SEQ ID NO: 126
  Description of Artificial Sequence: Synthetic polypeptide
  MOD_RES (29)..(29): D-amino acid

SEQ ID NO: 195 - protein, 33 aa, Artificial Sequence; identical to SEQ ID NO: 126
  Description of Artificial Sequence: Synthetic polypeptide
  MOD_RES (3)..(3): D-amino acid

SEQ ID NO: 196 - protein, 33 aa, Artificial Sequence; identical to SEQ ID NO: 126
  Description of Artificial Sequence: Synthetic polypeptide
  MOD_RES (4)..(4): D-amino acid

SEQ ID NO: 197 - protein, 24 aa, Artificial Sequence
  Description of Artificial Sequence: Synthetic peptide
CGLFEAIEGFIENGWEGMIDGWYG

SEQ ID NO: 198 - protein, 11 aa, Artificial Sequence
  Description of Artificial Sequence: Synthetic peptide
CYGRKKRRQRR

SEQ ID NO: 199 - protein, 11 aa, Artificial Sequence
  Description of Artificial Sequence: Synthetic peptide
YGRKKRRQRRC

SEQ ID NO: 200 - protein, 34 aa, Artificial Sequence; identical to SEQ ID NO: 191
  Description of Artificial Sequence: Synthetic polypeptide
  MOD_RES (1)..(34): D-amino acid

SEQ ID NO: 201 - protein, 34 aa, Artificial Sequence; identical to SEQ ID NO: 6
  Description of Artificial Sequence: Synthetic polypeptide
  MOD_RES (1)..(34): D-amino acid

SEQ ID NO: 202 - protein, 34 aa, Artificial Sequence
  Description of Artificial Sequence: Synthetic polypeptide
CGLFEAIEGFIENGWEGMIDGAYGYGRKKRRQRR

SEQ ID NO: 203 - protein, 34 aa, Artificial Sequence
  Description of Artificial Sequence: Synthetic polypeptide
CGLFEALLELLESLWELLLEAWYGYGRKKRRQRR

SEQ ID NO: 204 - protein, 34 aa, Artificial Sequence
  Description of Artificial Sequence: Synthetic polypeptide
CGLFEAIEGFNENGWEGMIDGWYGYGRKKRRQRR

SEQ ID NO: 205 - protein, 34 aa, Artificial Sequence
  Description of Artificial Sequence: Synthetic polypeptide
CGLFEAIEGFIENEWEGMIDGWYGYGRKKRRQRR

SEQ ID NO: 206 - protein, 35 aa, Artificial Sequence
  Description of Artificial Sequence: Synthetic polypeptide
KGLFEAIEGFIENGWEGMIDGWYGYGRKKRRQRRC

SEQ ID NO: 207 - protein, 34 aa, Artificial Sequence; identical to SEQ ID NO: 145
  Description of Artificial Sequence: Synthetic polypeptide

SEQ ID NO: 208 - protein, 34 aa, Artificial Sequence; identical to SEQ ID NO: 145
  Description of Artificial Sequence: Synthetic polypeptide

SEQ ID NO: 209 - protein, 34 aa, Artificial Sequence
  Description of Artificial Sequence: Synthetic polypeptide
CGLFEAIEGFIENPWEGMIDGWYGYGRKKRRQRR

SEQ ID NO: 210 - protein, 34 aa, Artificial Sequence
  Description of Artificial Sequence: Synthetic polypeptide
GLFEAIEGFIENPWEGMIDGWYGYGRKKRRQRRC

SEQ ID NO: 211 - protein, 63 aa, Artificial Sequence
  Description of Artificial Sequence: Synthetic polypeptide
CGLFGAIAGFIEGGWPGLINGWYGYGRKKRRQRRLHLLHHLLHHLHHLLHHLLHLLHHLLHHL

SEQ ID NO: 212 - protein, 55 aa, Artificial Sequence
  Description of Artificial Sequence: Synthetic polypeptide
CGLFGAIAGFIEGGWPGLINGWYGYGRKKRRQRRLHLLHHLLHHLHHLLHHLLHL

SEQ ID NO: 213 - protein, 34 aa, Artificial Sequence
  Description of Artificial Sequence: Synthetic polypeptide
CGLFEAIAGFIEGGWPGLINGWYGYGRKKRRQRR

SEQ ID NO: 214 - protein, 34 aa, Artificial Sequence
  Description of Artificial Sequence: Synthetic polypeptide
CGLEEAIEGFIENGWEGMIDGWYGYGRKKRRQRR

SEQ ID NO: 215 - protein, 34 aa, Artificial Sequence
  Description of Artificial Sequence: Synthetic polypeptide
CGLFNAIEGFIENGWEGMIDGWYGYGRKKRRQRR

SEQ ID NO: 216 - protein, 34 aa, Artificial Sequence
  Description of Artificial Sequence: Synthetic polypeptide
CGLFAAIEGFIENGWEGMIDGWYGYGRKKRRQRR

SEQ ID NO: 217 - protein, 34 aa, Artificial Sequence
  Description of Artificial Sequence: Synthetic polypeptide
CGLFEAIENFIENGWEGMIDGWYGYGRKKRRQRR

SEQ ID NO: 218 - protein, 34 aa, Artificial Sequence
  Description of Artificial Sequence: Synthetic polypeptide
CGLFEAIEKFIENGWEGMIDGWYGYGRKKRRQRR

SEQ ID NO: 219 - protein, 34 aa, Artificial Sequence
  Description of Artificial Sequence: Synthetic polypeptide
CGLFEAIEGFAENGWEGMIDGWYGYGRKKRRQRR

SEQ ID NO: 220 - protein, 34 aa, Artificial Sequence
  Description of Artificial Sequence: Synthetic polypeptide
CGLFEAIEGFIENWWEGMIDGWYGYGRKKRRQRR

SEQ ID NO: 221 - protein, 34 aa, Artificial Sequence
  Description of Artificial Sequence: Synthetic polypeptide
CGLFEAIEGFIENNWEGMIDGWYGYGRKKRRQRR

SEQ ID NO: 222 - protein, 34 aa, Artificial Sequence
  Description of Artificial Sequence: Synthetic polypeptide
CGLFEAIEGFIENGEEGMIDGWYGYGRKKRRQRR

SEQ ID NO: 223 - protein, 34 aa, Artificial Sequence
  Description of Artificial Sequence: Synthetic polypeptide
CGLFEAIEGFIENGWAGMIDGWYGYGRKKRRQRR

SEQ ID NO: 224 - protein, 34 aa, Artificial Sequence
  Description of Artificial Sequence: Synthetic polypeptide
CGLFEAIEGFIENGWNGMIDGWYGYGRKKRRQRR

SEQ ID NO: 225 - protein, 34 aa, Artificial Sequence
  Description of Artificial Sequence: Synthetic polypeptide
CGLFEAIEGFIENGWGGMIDGWYGYGRKKRRQRR

SEQ ID NO: 226 - protein, 34 aa, Artificial Sequence
  Description of Artificial Sequence: Synthetic polypeptide
CGLFEAIEGFIENGWEGMIDAWYGYGRKKRRQRR

SEQ ID NO: 227 - protein, 34 aa, Artificial Sequence
  Description of Artificial Sequence: Synthetic polypeptide
CGLFEAIEGFIENGWLGMIDGWYGYGRKKRRQRR

SEQ ID NO: 228 - protein, 34 aa, Artificial Sequence
  Description of Artificial Sequence: Synthetic polypeptide
CGLFEAIEGFIENGWKGMIDGWYGYGRKKRRQRR

SEQ ID NO: 229 - protein, 34 aa, Artificial Sequence
  Description of Artificial Sequence: Synthetic polypeptide
CGLFEAIEGFIENGWEGMIDKWYGYGRKKRRQRR

SEQ ID NO: 230 - protein, 34 aa, Artificial Sequence
  Description of Artificial Sequence: Synthetic polypeptide
CGLFEAIEGFIENGWEGMIDEWYGYGRKKRRQRR

SEQ ID NO: 231 - protein, 34 aa, Artificial Sequence
  Description of Artificial Sequence: Synthetic polypeptide
CGLFEAIEGFIENGWEGMIDGLYGYGRKKRRQRR

SEQ ID NO: 232 - protein, 34 aa, Artificial Sequence
  Description of Artificial Sequence: Synthetic polypeptide
CGLFEAIEGFIENGWEGMIDGNYGYGRKKRRQRR

SEQ ID NO: 233 - protein, 34 aa, Artificial Sequence
  Description of Artificial Sequence: Synthetic polypeptide
CGLFEAIEGFIENGWEGMIDGKYGYGRKKRRQRR

SEQ ID NO: 234 - protein, 34 aa, Artificial Sequence
  Description of Artificial Sequence: Synthetic polypeptide
CGLFEAIEGFIENGWEGMIDGEYGYGRKKRRQRR

SEQ ID NO: 235 - protein, 34 aa, Artificial Sequence
  Description of Artificial Sequence: Synthetic polypeptide
CGLFEALEELLEGGWEGLIEAWYGYGRKKRRQRR

SEQ ID NO: 236 - protein, 34 aa, Artificial Sequence
  Description of Artificial Sequence: Synthetic polypeptide
CELFGAIWEFIEGGWEGLIEAWYGYGRKKRRQRR

SEQ ID NO: 237 - protein, 34 aa, Artificial Sequence
  Description of Artificial Sequence: Synthetic polypeptide
CGLFEALEEFIEGGWEGLLEAWYGYGRKKRRQRR

SEQ ID NO: 238 - protein, 34 aa, Artificial Sequence
  Description of Artificial Sequence: Synthetic polypeptide
CGLFEALEEFIENGWEGLLEAWYGYGRKKRRQRR

SEQ ID NO: 239 - protein, 34 aa, Artificial Sequence
  Description of Artificial Sequence: Synthetic polypeptide
CGLFEAIEGFIESGWEGLIDGWYGYGRKKRRQRR

SEQ ID NO: 240 - protein, 34 aa, Artificial Sequence
  Description of Artificial Sequence: Synthetic polypeptide
CGLFEAIEEFIEGGWEGLIEAWYGYGRKKRRQRR

SEQ ID NO: 241 - protein, 34 aa, Artificial Sequence
  Description of Artificial Sequence: Synthetic polypeptide
CGLFEAIEGFIENGWEGLIDAWYGYGRKKRRQRR

SEQ ID NO: 242 - protein, 34 aa, Artificial Sequence
  Description of Artificial Sequence: Synthetic polypeptide
CGLFEAIEGFILNGWEGMIDGWYGYGRKKRRQRR

SEQ ID NO: 243 - protein, 34 aa, Artificial Sequence
  Description of Artificial Sequence: Synthetic polypeptide
CGLFEAIEGFIKNGWEGMIDGWYGYGRKKRRQRR

SEQ ID NO: 244 - protein, 34 aa, Artificial Sequence
  Description of Artificial Sequence: Synthetic polypeptide
CGLFEAIEGFIGNGWEGMIDGWYGYGRKKRRQRR

SEQ ID NO: 245 - protein, 34 aa, Artificial Sequence
  Description of Artificial Sequence: Synthetic polypeptide
CGLFEAIEGFIELGWEGMIDGWYGYGRKKRRQRR

SEQ ID NO: 246 - protein, 34 aa, Artificial Sequence
  Description of Artificial Sequence: Synthetic polypeptide
CGLFEAIEGFIEKGWEGMIDGWYGYGRKKRRQRR

SEQ ID NO: 247 - protein, 34 aa, Artificial Sequence
  Description of Artificial Sequence: Synthetic polypeptide
CGLFEAIAEFIEGGWEGLIEGWYGYGRKKRRQRR

SEQ ID NO: 248 - protein, 16 aa, Artificial Sequence
  Description of Artificial Sequence: Synthetic peptide
CRGWEVLKYWWNLLQY

SEQ ID NO: 249 - protein, 26 aa, Artificial Sequence
  Description of Artificial Sequence: Synthetic peptide
CRGWEVLKYWWNLLQYYGRKKRRQRR

SEQ ID NO: 250 - protein, 36 aa, Artificial Sequence
  Description of Artificial Sequence: Synthetic polypeptide
CGLFGAIAGFIENGWEGMIDGWYGFRYGRKKRRQRR

SEQ ID NO: 251 - protein, 34 aa, Artificial Sequence; identical to SEQ ID NO: 32
  Description of Artificial Sequence: Synthetic polypeptide

SEQ ID NO: 252 - protein, 34 aa, Artificial Sequence
  Description of Artificial Sequence: Synthetic polypeptide
CGLLEALEGLLENGWEGLLEAWYGYGRKKRRQRR

SEQ ID NO: 253 - protein, 30 aa, Artificial Sequence
  Description of Artificial Sequence: Synthetic polypeptide
CLRHLLRHLLRHLRHLLRHLRHLLRHLLRH

SEQ ID NO: 254 - protein, 34 aa, Artificial Sequence
  Description of Artificial Sequence: Synthetic polypeptide
  MOD_RES (28)..(29): Ornithine
CGIFEAIEGFIENGWEGIIDGWYGYGRXXRRQRR

SEQ ID NO: 255 - protein, 27 aa, Artificial Sequence
  Description of Artificial Sequence: Synthetic peptide
CGIGAVLKVLTTGLPALISWIKRKRQQ

SEQ ID NO: 256 - protein, 27 aa, Artificial Sequence
  Description of Artificial Sequence: Synthetic peptide
CGIGAVLKVLTTGLPALISWIHHHHQQ

SEQ ID NO: 257 - protein, 34 aa, Artificial Sequence
  Description of Artificial Sequence: Synthetic polypeptide
CGAFEAIEGFIENGWEGMIDGWYGYGRKKRRQRR

SEQ ID NO: 258 - protein, 34 aa, Artificial Sequence
  Description of Artificial Sequence: Synthetic polypeptide
LHLLHHLLHHLHHLLHHLLHLLHHLLHHLRRRRR

SEQ ID NO: 259 - protein, 34 aa, Artificial Sequence
  Description of Artificial Sequence: Synthetic polypeptide
CGLFGAIWGFIENWWKGLIDWWYGYGRKKRRQRR

SEQ ID NO: 260 - protein, 34 aa, Artificial Sequence
  Description of Artificial Sequence: Synthetic polypeptide
CGLFGAIEGFIENGWKGLIDAWYGYGRKKRRQRR

SEQ ID NO: 261 - protein, 34 aa, Artificial Sequence
  Description of Artificial Sequence: Synthetic polypeptide
CGLFEAIAGFIENGWKGLIDWWYGYGRKKRRQRR

SEQ ID NO: 262 - protein, 34 aa, Artificial Sequence
  Description of Artificial Sequence: Synthetic polypeptide
GLFEAIEGFIENGWKGLIDWWYGYGRKKRRQRRC

SEQ ID NO: 263 - protein, 34 aa, Artificial Sequence
  Description of Artificial Sequence: Synthetic polypeptide
YGRKKRRQRRGLFEAIEGFIENGWKGLIDAWYGC

SEQ ID NO: 264 - protein, 34 aa, Artificial Sequence
  Description of Artificial Sequence: Synthetic polypeptide
YGRKKRRQRRGLFEAIEGFIENGWKGLIDWWYGC

SEQ ID NO: 265 - protein, 34 aa, Artificial Sequence
  Description of Artificial Sequence: Synthetic polypeptide
CGLFHAIHGFIENGWHGLIDWWYGYGRKKRRQRR

SEQ ID NO: 266 - protein, 35 aa, Artificial Sequence
  Description of Artificial Sequence: Synthetic polypeptide
CGLFEAIEGFIENGWKGLIDWWYGYGRKKRRQRRK

SEQ ID NO: 267 - protein, 34 aa, Artificial Sequence
  Description of Artificial Sequence: Synthetic polypeptide
CGLFKALLKLLKSLWKLLLKAWYGYGHKKHHQHR

SEQ ID NO: 268 - protein, 34 aa, Artificial Sequence
  Description of Artificial Sequence: Synthetic polypeptide
CGLFKALLKLLKSLWKGLLKAWYGYGHKKHHQHR

SEQ ID NO: 269 - protein, 34 aa, Artificial Sequence
  Description of Artificial Sequence: Synthetic polypeptide
CGLAKALLKLLKSLWKGLIEAWYGYGRKKRRQRR

SEQ ID NO: 270 - protein, 15 aa, Artificial Sequence
  Description of Artificial Sequence: Synthetic peptide
CGIFGAIAGFIKNIW

SEQ ID NO: 271 - protein, 33 aa, Artificial Sequence
  Description of Artificial Sequence: Synthetic polypeptide
CIFGAIAGFIKNIWEGLIDGWYGYGRKKRRQRR

SEQ ID NO: 272 - protein, 31 aa, Artificial Sequence
  Description of Artificial Sequence: Synthetic polypeptide
CGIFGAIAGFIKNIWEGLIDGYGRKKRRQRR

SEQ ID NO: 273 - protein, 34 aa, Artificial Sequence
  Description of Artificial Sequence: Synthetic polypeptide
CGIFGAIAGFIKNIWKGLIDAWYGYGRKKRRQRR

SEQ ID NO: 274 - protein, 33 aa, Artificial Sequence
  Description of Artificial Sequence: Synthetic polypeptide
CIFGAIAGFIKNIWKGLIDWWYGYGRKKRRQRR

SEQ ID NO: 275 - protein, 14 aa, Artificial Sequence
  Description of Artificial Sequence: Synthetic peptide
CLFGAIAGFIKNIW

SEQ ID NO: 276 - protein, 45 aa, Artificial Sequence
  Description of Artificial Sequence: Synthetic polypeptide
CGLRRRRREAIEGFSSSSSSSSENGWEGMIDGWYGYGRKKRRQRR

SEQ ID NO: 277 - protein, 42 aa, Artificial Sequence
  Description of Artificial Sequence: Synthetic polypeptide
CGLFEASSSSSEGFSSSSSENGWEGMIDGWYGYGRKKRRQRR

SEQ ID NO: 278 - protein, 34 aa, Artificial Sequence
  Description of Artificial Sequence: Synthetic polypeptide
CGLFEAIEGFIENGWEGAIDGWYGYGRKKRRQRR

SEQ ID NO: 279 - protein, 34 aa, Artificial Sequence
  Description of Artificial Sequence: Synthetic polypeptide
CGLFEAIEGFIENGWEGEIDGWYGYGRKKRRQRR

SEQ ID NO: 280 - protein, 33 aa, Artificial Sequence
  Description of Artificial Sequence: Synthetic polypeptide
CGIFGAIAGFIKNGWEGMVDWYGYGRKKRRQRR

SEQ ID NO: 281 - protein, 35 aa, Artificial Sequence
  Description of Artificial Sequence: Synthetic polypeptide
CGLFEAIAGFIENGWEGMIDGWYGFYGRKKRRQRR

SEQ ID NO: 282 - protein, 34 aa, Artificial Sequence
  Description of Artificial Sequence: Synthetic polypeptide
CGIFGAIAGFIKNGWEGMIDGWYGYGRKKRRQRR

SEQ ID NO: 283 - protein, 14 aa, Artificial Sequence
  Description of Artificial Sequence: Synthetic peptide
CIFGAIAGFIKNIW

SEQ ID NO: 284 - protein, 24 aa, Artificial Sequence
  Description of Artificial Sequence: Synthetic peptide
CIFGAIAGFIKNIWYGRKKRRQRR

SEQ ID NO: 285 - protein, 34 aa, Artificial Sequence
  Description of Artificial Sequence: Synthetic polypeptide
CGIFGAIAGFIKNIWEGMIDGWYGYGRKKRRQRR

SEQ ID NO: 286 - protein, 31 aa, Artificial Sequence
  Description of Artificial Sequence: Synthetic polypeptide
CGLFEAIEGFIENGWEGLIEAYGRKKRRQRR

SEQ ID NO: 287 - protein, 31 aa, Artificial Sequence
  Description of Artificial Sequence: Synthetic polypeptide
CGLFEALLGFIENGWEGLIDGYGRKKRRQRR

SEQ ID NO: 288 - protein, 35 aa, Artificial Sequence
  Description of Artificial Sequence: Synthetic polypeptide
CGLFGAIEGFIENGWEGLIDGWYGYGRKKRRQRRR

SEQ ID NO: 289 - protein, 35 aa, Artificial Sequence
  Description of Artificial Sequence: Synthetic polypeptide
CELFGAIEGFIENGWEGMIDGWYGYGRKKRRQRRR

SEQ ID NO: 290 - protein, 34 aa, Artificial Sequence
  Description of Artificial Sequence: Synthetic polypeptide
CGLFEAIEGFIENGWEGMIDGWYGYGHKKHHQHR

SEQ ID NO: 291 - protein, 35 aa, Artificial Sequence
  Description of Artificial Sequence: Synthetic polypeptide
CGLFGAIEGFIEGGWPGLINGWYGYGRKKRRQRRR

SEQ ID NO: 292 - protein, 31 aa, Artificial Sequence
  Description of Artificial Sequence: Synthetic polypeptide
CGLFKALLKLLKSLWKLLLKAYGRKKRRQRR

SEQ ID NO: 293 - protein, 34 aa, Artificial Sequence
  Description of Artificial Sequence: Synthetic polypeptide
CGLFKALLKLLKSLWKLLLKAWYGYGRKKRRQRR

SEQ ID NO: 294 - protein, 31 aa, Artificial Sequence
  Description of Artificial Sequence: Synthetic polypeptide
CGLFRALLRLLRSLWRLLLRAYGRKKRRQRR

SEQ ID NO: 295 - protein, 34 aa, Artificial Sequence
  Description of Artificial Sequence: Synthetic polypeptide
CGLFEAILGFIENGWEGLIDGWYGYGRKKRRQRR

SEQ ID NO: 296 - protein, 34 aa, Artificial Sequence
  Description of Artificial Sequence: Synthetic polypeptide
CGLFEAIWEFIENGWEGLIDGWYGYGRKKRRQRR

SEQ ID NO: 297 - protein, 48 aa, Artificial Sequence
  Description of Artificial Sequence: Synthetic polypeptide
CGLFEAIEGFIENGWEGMIDGWYGGGGLHLLHHLLHHLHHLLHHLLHL

SEQ ID NO: 298 - protein, 31 aa, Artificial Sequence
  Description of Artificial Sequence: Synthetic polypeptide
CGPVEDAITAAIGRVADTVGTYGRKKRRQRR

SEQ ID NO: 299 - protein, 25 aa, Artificial Sequence
  Description of Artificial Sequence: Synthetic peptide
CMDGTLFPGDDDLAIPATEFFSTKA

SEQ ID NO: 300 - protein, 34 aa, Artificial Sequence; identical to SEQ ID NO: 237
  Description of Artificial Sequence: Synthetic polypeptide

SEQ ID NO: 301 - protein, 34 aa, Artificial Sequence; identical to SEQ ID NO: 238
  Description of Artificial Sequence: Synthetic polypeptide

SEQ ID NO: 302 - protein, 31 aa, Artificial Sequence
  Description of Artificial Sequence: Synthetic polypeptide
CELFGAIWEFIEGGWEGLIEAYGRKKRRQRR

SEQ ID NO: 303 - protein, 34 aa, Artificial Sequence; identical to SEQ ID NO: 41
  Description of Artificial Sequence: Synthetic polypeptide

SEQ ID NO: 304 - protein, 34 aa, Artificial Sequence; identical to SEQ ID NO: 39
  Description of Artificial Sequence: Synthetic polypeptide

SEQ ID NO: 305 - protein, 34 aa, Artificial Sequence
  Description of Artificial Sequence: Synthetic polypeptide
CGLFEAIAEFIEGLWEGLIEGWYGYGRKKRRQRR

SEQ ID NO: 306 - protein, 34 aa, Artificial Sequence; identical to SEQ ID NO: 22
  Description of Artificial Sequence: Synthetic polypeptide

SEQ ID NO: 307 - protein, 34 aa, Artificial Sequence
  Description of Artificial Sequence: Synthetic polypeptide
CGLFEAIEGFIENGWEGMIDIWYGYGRKKRRQRR

SEQ ID NO: 308 - protein, 34 aa, Artificial Sequence
  Description of Artificial Sequence: Synthetic polypeptide
CGLFEAIEGFIENGWRGMIDGWYGYGRKKRRQRR

SEQ ID NO: 309 - protein, 34 aa, Artificial Sequence
  Description of Artificial Sequence: Synthetic polypeptide
CGLFEAIEGFIENGWDGMIDGWYGYGRKKRRQRR

SEQ ID NO: 310 - protein, 34 aa, Artificial Sequence
  Description of Artificial Sequence: Synthetic polypeptide
CGLFEAIEGFIENHWEGMIDGWYGYGRKKRRQRR

SEQ ID NO: 311 - protein, 34 aa, Artificial Sequence
  Description of Artificial Sequence: Synthetic polypeptide
CGLFEAIEGFIENWWKGLIDWWYGYGRKKRRQRR

SEQ ID NO: 312 - protein, 34 aa, Artificial Sequence
  Description of Artificial Sequence: Synthetic polypeptide
GLFEAIEGFIENGWKGLIDAWYGYGRKKRRQRRC

SEQ ID NO: 313 - protein, 34 aa, Artificial Sequence
  Description of Artificial Sequence: Synthetic polypeptide
CGLFEAIEGFIENGWKGMIDAWYGYGRKKRRQRR

SEQ ID NO: 314 - protein, 34 aa, Artificial Sequence
  Description of Artificial Sequence: Synthetic polypeptide
CGLFEAIEGFIENGWKGMIDWWYGYGRKKRRQRR

SEQ ID NO: 315 - protein, 34 aa, Artificial Sequence
  Description of Artificial Sequence: Synthetic polypeptide
CGLAEAIEGFIENGLKGLIDWWYGYGRKKRRQRR

SEQ ID NO: 316 - protein, 34 aa, Artificial Sequence
  Description of Artificial Sequence: Synthetic polypeptide
  MOD_RES (1)..(34): D-amino acid
RRQRRKKRGYGYWGDILGEWGNEIFGEIAEFLGC

SEQ ID NO: 317 - protein, 34 aa, Artificial Sequence; identical to SEQ ID NO: 58
  Description of Artificial Sequence: Synthetic polypeptide
  MOD_RES (1)..(34): D-amino acid

SEQ ID NO: 318 - protein, 34 aa, Artificial Sequence
  Description of Artificial Sequence: Synthetic polypeptide
CGLFEAIEGFIENGWKGLIDWWYGYGRKKRRQRR

SEQ ID NO: 319 - protein, 34 aa, Artificial Sequence
  Description of Artificial Sequence: Synthetic polypeptide
CGFFEAIEGFIENGLKGLIDAWYGYGRKKRRQRR

SEQ ID NO: 320 - protein, 34 aa, Artificial Sequence
  Description of Artificial Sequence: Synthetic polypeptide
CGLFEAIEGFIENGLKGLIDAWYGYGRKKRRQRR

SEQ ID NO: 321 - protein, 34 aa, Artificial Sequence
  Description of Artificial Sequence: Synthetic polypeptide
CELFGAIEGFIENGWKGLIDAWYGYGRKKRRQRR

SEQ ID NO: 322 - protein, 34 aa, Artificial Sequence
  Description of Artificial Sequence: Synthetic polypeptide
CGLFKAIKGFIKNGWKGLIKAWYGYGRKKRRQRR

SEQ ID NO: 323 - protein, 31 aa, Artificial Sequence
  Description of Artificial Sequence: Synthetic polypeptide
CGLAEALLELLESLWKGLIEAYGRKKRRQRR

SEQ ID NO: 324 - protein, 34 aa, Artificial Sequence
  Description of Artificial Sequence: Synthetic polypeptide
CGIFGAIEGFIENGWKGLIDAWYGYGRKKRRQRR

SEQ ID NO: 325 - protein, 34 aa, Artificial Sequence
  Description of Artificial Sequence: Synthetic polypeptide
CGIAGAIAGFIKNIWEGLIDWWYGYGRKKRRQRR

SEQ ID NO: 326 - protein, 34 aa, Artificial Sequence
  Description of Artificial Sequence: Synthetic polypeptide
CGIAGAIAGFIKNIWKGLIDAWYGYGRKKRRQRR

SEQ ID NO: 327 - protein, 33 aa, Artificial Sequence
  Description of Artificial Sequence: Synthetic polypeptide
CGIFGAIAGFIKNIWEGLIDGWYGKKKKKKKKK

SEQ ID NO: 328 - protein, 45 aa, Artificial Sequence
  Description of Artificial Sequence: Synthetic polypeptide
CGRRRRRFEAIEGSSSSSSSSIENGWEGMIDGWYGYGRKKRRQRR

SEQ ID NO: 329 - protein, 45 aa, Artificial Sequence
  Description of Artificial Sequence: Synthetic polypeptide
CGLFEAIEGFRRRRRENGWEGSSSSSSSSIDGWYGYGRKKRRQRR

SEQ ID NO: 330 - protein, 34 aa, Artificial Sequence
  Description of Artificial Sequence: Synthetic polypeptide
GLFEAIEGFIENGWEGMIDGWYGCYGRKKRRQRR

SEQ ID NO: 331 - protein, 36 aa, Artificial Sequence
  Description of Artificial Sequence: Synthetic polypeptide
GLFEAIEGFIENGWEGMIDGWYGGCGYGRKKRRQRR

SEQ ID NO: 332 - protein, 33 aa, Artificial Sequence
  Description of Artificial Sequence: Synthetic polypeptide
GLLEALEGLLENGWEGLLDGWYGYGRKKRRQRR

SEQ ID NO: 333 - protein, 14 aa, Artificial Sequence
  Description of Artificial Sequence: Synthetic peptide
CFFGAIWEFIRNIL

SEQ ID NO: 334 - protein, 14 aa, Artificial Sequence
  Description of Artificial Sequence: Synthetic peptide
CIFGAIAGFIRSIL

SEQ ID NO: 335 - protein, 34 aa, Artificial Sequence
  Description of Artificial Sequence: Synthetic polypeptide
CGLFEEIEEFIENGWEGLIDWWYGYGRKKRRQRR

SEQ ID NO: 336 - protein, 15 aa, Artificial Sequence
  Description of Artificial Sequence: Synthetic peptide
CGFFGAIWEFIKSIL

SEQ ID NO: 337 - protein, 15 aa, Artificial Sequence
  Description of Artificial Sequence: Synthetic peptide
GFFGAIWEFIKSILC

SEQ ID NO: 338 - protein, 34 aa, Artificial Sequence
  Description of Artificial Sequence: Synthetic polypeptide
  MOD_RES (28)..(29): Ornithine
CGLFEALEGFIENGWEGLLDGWYGYGRXXRRQRR

SEQ ID NO: 339 - protein, 34 aa, Artificial Sequence
  Description of Artificial Sequence: Synthetic polypeptide
CGLFEALLELLENGWELLLEAWYGYGRKKRRQRR

SEQ ID NO: 340 - protein, 34 aa, Artificial Sequence
  Description of Artificial Sequence: Synthetic polypeptide
CGLFEALLELLENGWELLLDGWYGYGRKKRRQRR

SEQ ID NO: 341 - protein, 34 aa, Artificial Sequence
  Description of Artificial Sequence: Synthetic polypeptide
CALFEAIEAFIENGWEAMIDAWYGYGRKKRRQRR

SEQ ID NO: 342 - protein, 34 aa, Artificial Sequence
  Description of Artificial Sequence: Synthetic polypeptide
CGLFGAIWGFIENGWEGLIDGWYGYGRKKRRQRR

SEQ ID NO: 343 - protein, 34 aa, Artificial Sequence
  Description of Artificial Sequence: Synthetic polypeptide
CGLFEAIEELIENLWKGLIDWWYGYGRKKRRQRR

SEQ ID NO: 344 - protein, 34 aa, Artificial Sequence
  Description of Artificial Sequence: Synthetic polypeptide
CGLFEEIEGFIENGWKGLIDWWYGYGRKKRRQRR

SEQ ID NO: 345 - protein, 34 aa, Artificial Sequence
  Description of Artificial Sequence: Synthetic polypeptide
CGLFEEIEGFIENGWKGLIDWWYGYGHKKHHQHR

SEQ ID NO: 346 - protein, 23 aa, Artificial Sequence
  Description of Artificial Sequence: Synthetic peptide
CFFGAIWEFIKNILKGLIDGWYG

SEQ ID NO: 347 - protein, 15 aa, Artificial Sequence
  Description of Artificial Sequence: Synthetic peptide
CGIFGAIAGFIRSIL

SEQ ID NO: 348 - protein, 34 aa, Artificial Sequence
  Description of Artificial Sequence: Synthetic polypeptide
CGLFEEIEGFIENGWEGMIDGWYGYGRKKRRQRR

SEQ ID NO: 349 - protein, 34 aa, Artificial Sequence
  Description of Artificial Sequence: Synthetic polypeptide
CGLFEAIEGFIENGWEGMIDGWNGYGRKKRRQRR

SEQ ID NO: 350 - protein, 34 aa, Artificial Sequence
  Description of Artificial Sequence: Synthetic polypeptide
AGYLLGKINLKALAALAKKILHHHHHHKKKKKKC

SEQ ID NO: 351 - protein, 34 aa, Artificial Sequence; identical to SEQ ID NO: 106
  Description of Artificial Sequence: Synthetic polypeptide

SEQ ID NO: 352 - protein, 34 aa, Artificial Sequence; identical to SEQ ID NO: 32
  Description of Artificial Sequence: Synthetic polypeptide
  misc_feature (24)..(25): Residues at these positions separated by a (PEG)6 moiety

SEQ ID NO: 353 - protein, 34 aa, Artificial Sequence
  Description of Artificial Sequence: Synthetic polypeptide
CGIFGAIWNGIKSLFEGLIDGWYGYGRKKRRQRR

SEQ ID NO: 354 - protein, 34 aa, Artificial Sequence
  Description of Artificial Sequence: Synthetic polypeptide
CGIFGAIEGFIENGWEGLIDWWYGYGRKKRRQRR

SEQ ID NO: 355 - protein, 33 aa, Artificial Sequence
  Description of Artificial Sequence: Synthetic polypeptide
CIFGAIAGFIKNIWEGLIDWWYGYGRKKRRQRR

SEQ ID NO: 356 - protein, 47 aa, Artificial Sequence; identical to SEQ ID NO: 70
  Description of Artificial Sequence: Synthetic polypeptide

SEQ ID NO: 357 - protein, 42 aa, Artificial Sequence
  Description of Artificial Sequence: Synthetic polypeptide
CWEAALAEALAEALAEHLAEALAEALEALAAYGRKKRRQRRK

SEQ ID NO: 358 - protein, 34 aa, Artificial Sequence; identical to SEQ ID NO: 318
  Description of Artificial Sequence: Synthetic polypeptide

SEQ ID NO: 359 - protein, 31 aa, Artificial Sequence
  Description of Artificial Sequence: Synthetic polypeptide
CGLFEELEELLEEGWEGLLEAYGRKKRRQRR

SEQ ID NO: 360 - protein, 34 aa, Artificial Sequence
  Description of Artificial Sequence: Synthetic polypeptide
CGNFEEIEEFIEEGLRNFIDWWYGYGHKKHHQHR

SEQ ID NO: 361 - protein, 33 aa, Artificial Sequence
  Description of Artificial Sequence: Synthetic polypeptide
CFFGAIWEFIRNILEGLIDWWYGYGRKKRRQRR

SEQ ID NO: 362 - protein, 35 aa, Artificial Sequence
  Description of Artificial Sequence: Synthetic polypeptide
CFFGAIWEFIKNILLHLLHHLLHHLHHLLHHLLHL

SEQ ID NO: 363 - protein, 34 aa, Artificial Sequence; identical to SEQ ID NO: 32
  Description of Artificial Sequence: Synthetic polypeptide
  MOD_RES (1)..(34): D-amino acid

SEQ ID NO: 364 - protein, 21 aa, Artificial Sequence
  Description of Artificial Sequence: Synthetic peptide
CGFFHAFFHFFHSFWHGFFEA

SEQ ID NO: 365 - protein, 34 aa, Artificial Sequence
  Description of Artificial Sequence: Synthetic polypeptide
CGLFHALLHLLHSLWHGLLHWWYGYGHKKHHQHR

SEQ ID NO: 366 - protein, 31 aa, Artificial Sequence
  Description of Artificial Sequence: Synthetic polypeptide
CGLFGALLELLESLWEGLLEWYGRKKRRQRR

SEQ ID NO: 367 - protein, 31 aa, Artificial Sequence
  Description of Artificial Sequence: Synthetic polypeptide
CGLFGALLELLESLWEGLLEWYGHKKHHQHR

SEQ ID NO: 368 - protein, 25 aa, Artificial Sequence
  Description of Artificial Sequence: Synthetic peptide
CGLFHALLHLLHSLWKGLLEWWYGF

SEQ ID NO: 369 - protein, 17 aa, Artificial Sequence
  Description of Artificial Sequence: Synthetic peptide
CIFGAIAGFIRSILEGF

SEQ ID NO: 370 - protein, 21 aa, Artificial Sequence
  Description of Artificial Sequence: Synthetic peptide
CGIFGAIAGFIKNIWKGLIDA

SEQ ID NO: 371 - protein, 15 aa, Artificial Sequence
  Description of Artificial Sequence: Synthetic peptide
CFFEAIEEFIKNIWK

SEQ ID NO: 372 - protein, 35 aa, Artificial Sequence
  Description of Artificial Sequence: Synthetic polypeptide
CGLFEAIEGFIENGWKGLIDWLAEALAEALEALAA

SEQ ID NO: 373 - protein, 16 aa, Artificial Sequence
  Description of Artificial Sequence: Synthetic peptide
GCGIFGAIAEFIKNIW

SEQ ID NO: 374 - protein, 20 aa, Artificial Sequence
  Description of Artificial Sequence: Synthetic peptide
CIFGAIAEFIKNIWKGLIDW

SEQ ID NO: 375 - protein, 31 aa, Artificial Sequence
  Description of Artificial Sequence: Synthetic polypeptide
CFFGAIWEFIKSILELLLEAYGHKKHHQHRR

SEQ ID NO: 376 - protein, 14 aa, Artificial Sequence
  Description of Artificial Sequence: Synthetic peptide
CWFGAIWEFIKSIL

SEQ ID NO: 377 - protein, 14 aa, Artificial Sequence
  Description of Artificial Sequence: Synthetic peptide
CAFGAIWEFIKSIL

SEQ ID NO: 378 - protein, 14 aa, Artificial Sequence
  Description of Artificial Sequence: Synthetic peptide
CFLGAIWEFIKSIL

SEQ ID NO: 379 - protein, 14 aa, Artificial Sequence
  Description of Artificial Sequence: Synthetic peptide
CFFGAIWEFIKSIK

SEQ ID NO: 380 - protein, 34 aa, Artificial Sequence; identical to SEQ ID NO: 78
  Description of Artificial Sequence: Synthetic polypeptide
  MOD_RES (1)..(34): D-amino acid

SEQ ID NO: 381 - protein, 14 aa, Artificial Sequence
  Description of Artificial Sequence: Synthetic peptide
CFFGAIWEFIKSIL

SEQ ID NO: 382 - protein, 35 aa, Artificial Sequence; identical to SEQ ID NO: 87
  Description of Artificial Sequence: Synthetic polypeptide
  MOD_RES (1)..(35): D-amino acid

SEQ ID NO: 383 - protein, 14 aa, Artificial Sequence
  Description of Artificial Sequence: Synthetic peptide
CFFGAIAEFIKNIW

SEQ ID NO: 384 - protein, 14 aa, Artificial Sequence
  Description of Artificial Sequence: Synthetic peptide
CIFEAIWGFIKNIW

SEQ ID NO: 385 - protein, 34 aa, Artificial Sequence; identical to SEQ ID NO: 350
  Description of Artificial Sequence: Synthetic polypeptide

SEQ ID NO: 386 - protein, 33 aa, Artificial Sequence
  Description of Artificial Sequence: Synthetic polypeptide
CIFEAIAGFIKNIWKGLIDWWYGYGRKKRRQRR

SEQ ID NO: 387 - protein, 41 aa, Artificial Sequence
  Description of Artificial Sequence: Synthetic polypeptide
CGLFEAIEGFIENGWKGLIDWWYGGRPRESGKKRKRKRLKP

SEQ ID NO: 388 - protein, 34 aa, Artificial Sequence
  Description of Artificial Sequence: Synthetic polypeptide
  MOD_RES (2)..(2): b-Ala
CAGFGEIEEFIENGLKNLIDWWYGYGHKKHHQHR

SEQ ID NO: 389 - protein, 34 aa, Artificial Sequence
  Description of Artificial Sequence: Synthetic polypeptide
  MOD_RES (2)..(2): b-Ala
CAGFEFIEEFIENGLKNLIDWWYGYGRKKRRQRR

SEQ ID NO: 390 - protein, 34 aa, Artificial Sequence
  Description of Artificial Sequence: Synthetic polypeptide
  MOD_RES (2)..(2): b-Ala
CAGFEFIEEFIENGLKNLIDWWYGYGHKKHHQHR

SEQ ID NO: 391 - protein, 34 aa, Artificial Sequence
  Description of Artificial Sequence: Synthetic polypeptide
CGGIEEIAGLLSKILKGLIDWWYGYGHKKHHQHR

SEQ ID NO: 392 - protein, 34 aa, Artificial Sequence
  Description of Artificial Sequence: Synthetic polypeptide
CGFIGAIANLLSKIFEGLIDWWYGYGRKKRRQRR

SEQ ID NO: 393 - protein, 34 aa, Artificial Sequence
  Description of Artificial Sequence: Synthetic polypeptide
CGFIGAIAELLEKIFEGLIDWWYGYGRKKRRQRR

SEQ ID NO: 394 - protein, 34 aa, Artificial Sequence
  Description of Artificial Sequence: Synthetic polypeptide
CGFIGAIAELLEKIFEGLIDWWYGYGHKKHHQHR

SEQ ID NO: 395 - protein, 33 aa, Artificial Sequence
  Description of Artificial Sequence: Synthetic polypeptide
CFFGAIWEFIRNILEGLIDWWYGYGHKKHHQHR

SEQ ID NO: 396 - protein, 35 aa, Artificial Sequence
  Description of Artificial Sequence: Synthetic polypeptide
CFFGAIWEFIKSILLHLLHHLLHHLHHLLHHLLHL

SEQ ID NO: 397 - protein, 35 aa, Artificial Sequence
  Description of Artificial Sequence: Synthetic polypeptide
CFFGAIWEFIRSILLHLLHHLLHHLHHLLHHLLHL

SEQ ID NO: 398 - protein, 36 aa, Artificial Sequence
  Description of Artificial Sequence: Synthetic polypeptide
CGFFGAIWEFIRSILEGFIDWWYGYGYGHKKHHQHR

SEQ ID NO: 399 - protein, 31 aa, Artificial Sequence
  Description of Artificial Sequence: Synthetic polypeptide
CGLFEAIWEFIKSILEGLLEAYGHKKHHQHR

SEQ ID NO: 400 - protein, 34 aa, Artificial Sequence
  Description of Artificial Sequence: Synthetic polypeptide
CGLFEAIWEFIKSILEGLLEAWYGYGHKKHHQHR

SEQ ID NO: 401 - protein, 26 aa, Artificial Sequence
  Description of Artificial Sequence: Synthetic peptide
CGIFGAIAGFIKNIWKYGRKKRRQRR

SEQ ID NO: 402 - protein, 34 aa, Artificial Sequence
  Description of Artificial Sequence: Synthetic polypeptide
CGLFEALLELLESLWELLLEAWYGYGHKKHHQHR

SEQ ID NO: 403 - protein, 23 aa, Artificial Sequence
  Description of Artificial Sequence: Synthetic peptide
CIFGAIAGFIRNIWKGLIDGWYG

SEQ ID NO: 404 - protein, 24 aa, Artificial Sequence
  Description of Artificial Sequence: Synthetic peptide
CGIFGAIAGFIRNIWKGLIDGWYG

SEQ ID NO: 405 - protein, 36 aa, Artificial Sequence
  Description of Artificial Sequence: Synthetic polypeptide
CFFGAIWEFIKNILKLHLLHHLLHHLHHLLHHLLHL

SEQ ID NO: 406 - protein, 35 aa, Artificial Sequence
  Description of Artificial Sequence: Synthetic polypeptide
CFFGAIWEFIRNILLHLLHHLLHHLHHLLHHLLHL

SEQ ID NO: 407 - protein, 14 aa, Artificial Sequence
  Description of Artificial Sequence: Synthetic peptide
CFFGKIWEFIKSIL

SEQ ID NO: 408 - protein, 31 aa, Artificial Sequence
  Description of Artificial Sequence: Synthetic polypeptide
CYGRKKRRQRRGLFEALLELLESLWELLLEA

SEQ ID NO: 409 - protein, 14 aa, Artificial Sequence
  Description of Artificial Sequence: Synthetic peptide
FFGAIWEFIKSILC

SEQ ID NO: 410 - protein, 14 aa, Artificial Sequence
  Description of Artificial Sequence: Synthetic peptide
CWWGAIEGFIKSIL

SEQ ID NO: 411 - protein, 14 aa, Artificial Sequence
  Description of Artificial Sequence: Synthetic peptide
CFFGAIWEWIKSIL

SEQ ID NO: 412 - protein, 14 aa, Artificial Sequence
  Description of Artificial Sequence: Synthetic peptide
CFFGAIWEFWKSIL

SEQ ID NO: 413 - protein, 14 aa, Artificial Sequence
  Description of Artificial Sequence: Synthetic peptide
CFFGAIWEFIKFIL

SEQ ID NO: 414 - protein, 14 aa, Artificial Sequence
  Description of Artificial Sequence: Synthetic peptide
CFFGAIWEFIKKIL

SEQ ID NO: 415 - protein, 14 aa, Artificial Sequence
  Description of Artificial Sequence: Synthetic peptide
CFFGAIWEFIKGIL

SEQ ID NO: 416 - protein, 14 aa, Artificial Sequence
  Description of Artificial Sequence: Synthetic peptide
CFFGAIWEFIKLIL

SEQ ID NO: 417 - protein, 14 aa, Artificial Sequence
  Description of Artificial Sequence: Synthetic peptide
CFFGAIWEFIKWIL

SEQ ID NO: 418 - protein, 14 aa, Artificial Sequence
  Description of Artificial Sequence: Synthetic peptide
CFFGAIWEFIKSFL

SEQ ID NO: 419 - protein, 14 aa, Artificial Sequence
  Description of Artificial Sequence: Synthetic peptide
CFFGAIWEFIKSKL

SEQ ID NO: 420 - protein, 14 aa, Artificial Sequence
  Description of Artificial Sequence: Synthetic peptide
CFFGFIWEFIKSIL

SEQ ID NO: 421 - protein, 21 aa, Artificial Sequence
  Description of Artificial Sequence: Synthetic peptide
CIFGAIAGFIKNILKGLIDAF

SEQ ID NO: 422 - protein, 14 aa, Artificial Sequence
  Description of Artificial Sequence: Synthetic peptide
CFFGKIWELWEWIL

SEQ ID NO: 423 - protein, 14 aa, Artificial Sequence
  Description of Artificial Sequence: Synthetic peptide
CFFGAIWEFAKSIL

SEQ ID NO: 424 - protein, 14 aa, Artificial Sequence
  Description of Artificial Sequence: Synthetic peptide
CFFGAIWEFIKSAL

SEQ ID NO: 425 - protein, 14 aa, Artificial Sequence
  Description of Artificial Sequence: Synthetic peptide
CFFGAIWEFIKSWL

SEQ ID NO: 426 - protein, 15 aa, Artificial Sequence
  Description of Artificial Sequence: Synthetic peptide
CFFGAIWEFIKSILK

SEQ ID NO: 427 - protein, 15 aa, Artificial Sequence
  Description of Artificial Sequence: Synthetic peptide
CFFGAIWEFIKSILE

SEQ ID NO: 428 - protein, 14 aa, Artificial Sequence
  Description of Artificial Sequence: Synthetic peptide
CFFKAIWEFIKSIL

SEQ ID NO: 429 - protein, 14 aa, Artificial Sequence
  Description of Artificial Sequence: Synthetic peptide
CFFNAIWEFIKSIL

SEQ ID NO: 430 - protein, 14 aa, Artificial Sequence
  Description of Artificial Sequence: Synthetic peptide
CFFGGIWEFIKSIL

SEQ ID NO: 431 - protein, 14 aa, Artificial Sequence
  Description of Artificial Sequence: Synthetic peptide
CFFGNIWEFIKSIL

SEQ ID NO: 432 - protein, 14 aa, Artificial Sequence
  Description of Artificial Sequence: Synthetic peptide
CFFGALWEFIKSIL

SEQ ID NO: 433 - protein, 14 aa, Artificial Sequence
  Description of Artificial Sequence: Synthetic peptide
CFFGAAWEFIKSIL

SEQ ID NO: 434 - protein, 21 aa, Artificial Sequence
  Description of Artificial Sequence: Synthetic peptide
CGLFHALLHLLHSLWHGLLDG

SEQ ID NO: 435 - protein, 21 aa, Artificial Sequence
  Description of Artificial Sequence: Synthetic peptide
CGLFHALLHLLHSLWHGLLEW

SEQ ID NO: 436 - protein, 21 aa, Artificial Sequence
  Description of Artificial Sequence: Synthetic peptide
CGLFHALLHLLHSLWHLLLEA

SEQ ID NO: 437 - protein, 21 aa, Artificial Sequence
  Description of Artificial Sequence: Synthetic peptide
CGLFHALLHLLHSLWKLLLEW

SEQ ID NO: 438 - protein, 14 aa, Artificial Sequence
  Description of Artificial Sequence: Synthetic peptide
CKFGAIWEFIKSIL

SEQ ID NO: 439 - protein, 14 aa, Artificial Sequence
  Description of Artificial Sequence: Synthetic peptide
CFKGAIWEFIKSIL

SEQ ID NO: 440 - protein, 14 aa, Artificial Sequence
  Description of Artificial Sequence: Synthetic peptide
CFFGAIWKFIKSIL

SEQ ID NO: 441 - protein, 14 aa, Artificial Sequence
  Description of Artificial Sequence: Synthetic peptide
CFFGAIWAFIKSIL

SEQ ID NO: 442 - protein, 14 aa, Artificial Sequence
  Description of Artificial Sequence: Synthetic peptide
CFFGAIWLFIKSIL

SEQ ID NO: 443 - protein, 14 aa, Artificial Sequence
  Description of Artificial Sequence: Synthetic peptide
CFFGAIWFFIKSIL

SEQ ID NO: 444 - protein, 14 aa, Artificial Sequence
  Description of Artificial Sequence: Synthetic peptide
CFFGAIWNFIKSIL

SEQ ID NO: 445 - protein, 14 aa, Artificial Sequence
  Description of Artificial Sequence: Synthetic peptide
CFFGAIWELIKSIL

SEQ ID NO: 446 - protein, 14 aa, Artificial Sequence
  Description of Artificial Sequence: Synthetic peptide
CFFGAIWEAIKSIL

SEQ ID NO: 447 - protein, 41 aa, Artificial Sequence
  Description of Artificial Sequence: Synthetic polypeptide
CGLFEAIEGFIENGWEGLAEALAEALEALAAYGRKKRRQRR

SEQ ID NO: 448 - protein, 33 aa, Artificial Sequence
  Description of Artificial Sequence: Synthetic polypeptide
CIFGAIAGFIKNIWEGMIDGWYGYGRKKRRQRR

SEQ ID NO: 449 - protein, 33 aa, Artificial Sequence
  Description of Artificial Sequence: Synthetic polypeptide
CIFGAIAGFIKNIWEGLIDAWYGYGRKKRRQRR

SEQ ID NO: 450 - protein, 33 aa, Artificial Sequence
  Description of Artificial Sequence: Synthetic polypeptide
CIFGAIAGFIKNIWKGLIDAWYGYGRKKRRQRR

SEQ ID NO: 451 - protein, 40 aa, Artificial Sequence
  Description of Artificial Sequence: Synthetic polypeptide
CIFGAIAGFIKNIWIFGAIAGFIKNIWWYGYGRKKRRQRR

SEQ ID NO: 452 - protein, 24 aa, Artificial Sequence
  Description of Artificial Sequence: Synthetic peptide
CGLFGAIAGFIENGWEGLIEGWYG

SEQ ID NO: 453 - protein, 34 aa, Artificial Sequence; identical to SEQ ID NO: 14
  Description of Artificial Sequence: Synthetic polypeptide
  MOD_RES (27)..(31): Ornithine

SEQ ID NO: 454 - protein, 34 aa, Artificial Sequence; identical to SEQ ID NO: 318
  Description of Artificial Sequence: Synthetic polypeptide

SEQ ID NO: 455 - protein, 35 aa, Artificial Sequence
  Description of Artificial Sequence: Synthetic polypeptide
CGLFEAIEGFIENGWEGLIDGWYGYGRKKRRQRRK

SEQ ID NO: 456 - protein, 34 aa, Artificial Sequence
  Description of Artificial Sequence: Synthetic polypeptide
CYGHKKHHQHRGLFEAIEGFIENGWKGLIDWWYG

SEQ ID NO: 457 - protein, 34 aa, Artificial Sequence
  Description of Artificial Sequence: Synthetic polypeptide
CYGHKKHHQHRGLFEAIEEFIENGWEGLIDGWYG

SEQ ID NO: 458 - protein, 35 aa, Artificial Sequence
  Description of Artificial Sequence: Synthetic polypeptide
CGLFEAIEGFIENGWKGLIDGWYGYGRKKRRQRRK

SEQ ID NO: 459 - protein, 34 aa, Artificial Sequence
  Description of Artificial Sequence: Synthetic polypeptide
CGLFEAIEGFIENGWHGMIDGWYGYGRKKRRQRR

SEQ ID NO: 460 - protein, 39 aa, Artificial Sequence
  Description of Artificial Sequence: Synthetic polypeptide
IFGIDDLIIGLLFVAIVEAGIGGYLLGSYGRKKRRQRRC

SEQ ID NO: 461 - protein, 24 aa, Artificial Sequence
  Description of Artificial Sequence: Synthetic peptide
CGFFGEIAELIEEGLKGLIDWWNG

SEQ ID NO: 462 - protein, 24 aa, Artificial Sequence
  Description of Artificial Sequence: Synthetic peptide
CGLFGEIEELIEEGLENLIDWWNG

SEQ ID NO: 463 - protein, 14 aa, Artificial Sequence
  Description of Artificial Sequence: Synthetic peptide
  MOD_RES (1)..(14): D-amino acid
CFFGAIWEFIHSIL

SEQ ID NO: 464 - protein, 14 aa, Artificial Sequence
  Description of Artificial Sequence: Synthetic peptide
CFFGAIWEFIHNIL

SEQ ID NO: 465 - protein, 15 aa, Artificial Sequence
  Description of Artificial Sequence: Synthetic peptide
CFFGAIWEFIHSIFK

SEQ ID NO: 466 - protein, 16 aa, Artificial Sequence
  Description of Artificial Sequence: Synthetic peptide
CGIFEAIAGLLKWIFK

SEQ ID NO: 467 - protein, 16 aa, Artificial Sequence
  Description of Artificial Sequence: Synthetic peptide
CGIFELIAGLLKNIFK

SEQ ID NO: 468 - protein, 17 aa, Artificial Sequence
  Description of Artificial Sequence: Synthetic peptide
CGIFEAIAGLLKSILKK

SEQ ID NO: 469 - protein, 17 aa, Artificial Sequence
  Description of Artificial Sequence: Synthetic peptide
CGIFGAIAGLLKSILKK

SEQ ID NO: 470 - protein, 17 aa, Artificial Sequence
  Description of Artificial Sequence: Synthetic peptide
  MOD_RES (1)..(17): D-amino acid
CIFGAIAGFIKNILKGL

SEQ ID NO: 471 - protein, 24 aa, Artificial Sequence
  Description of Artificial Sequence: Synthetic peptide
CIFGAIAGFIKNILKGLIDGWWYG

SEQ ID NO: 472 - protein, 18 aa, Artificial Sequence
  Description of Artificial Sequence: Synthetic peptide
CIFGAIAGFIKNIWHGLI

SEQ ID NO: 473 - protein, 18 aa, Artificial Sequence
  Description of Artificial Sequence: Synthetic peptide
CIFGAIAGFIKNILKGLK

SEQ ID NO: 474 - protein, 18 aa, Artificial Sequence
  Description of Artificial Sequence: Synthetic peptide
  MOD_RES (1)..(18): D-amino acid
GLGKLINKIFGAIAGFIC

SEQ ID NO: 475 - protein, 16 aa, Artificial Sequence
  Description of Artificial Sequence: Synthetic peptide
CGIFEAIAGLLKNIFD

SEQ ID NO: 476 - protein, 16 aa, Artificial Sequence
  Description of Artificial Sequence: Synthetic peptide
CGIFEAIAGLLKNIFE

SEQ ID NO: 477 - protein, 16 aa, Artificial Sequence
  Description of Artificial Sequence: Synthetic peptide
CGIFEAIAGLLKNIFR

SEQ ID NO: 478 - protein, 16 aa, Artificial Sequence
  Description of Artificial Sequence: Synthetic peptide
CGIFEAIAGLLKNIFH

SEQ ID NO: 479 - protein, 16 aa, Artificial Sequence
  Description of Artificial Sequence: Synthetic peptide
  MOD_RES (16)..(16): Ornithine
CGIFEAIAGLLKNIFX

SEQ ID NO: 480 - protein, 16 aa, Artificial Sequence
  Description of Artificial Sequence: Synthetic peptide
CGIFEAIAGLLKNIFN

SEQ ID NO: 481 - protein, 16 aa, Artificial Sequence
  Description of Artificial Sequence: Synthetic peptide
  MOD_RES (16)..(16): Cit
CGIFEAIAGLLKNIFX

SEQ ID NO: 482 - protein, 16 aa, Artificial Sequence
  Description of Artificial Sequence: Synthetic peptide
CGIFEAIWGLLKNIFK

SEQ ID NO: 483 - protein, 16 aa, Artificial Sequence
  Description of Artificial Sequence: Synthetic peptide
CGIFGAIWGLLKNIFK

SEQ ID NO: 484 - protein, 15 aa, Artificial Sequence
  Description of Artificial Sequence: Synthetic peptide
CIFGAIAGLLKNIFK

SEQ ID NO: 485 - protein, 15 aa, Artificial Sequence
  Description of Artificial Sequence: Synthetic peptide
CIFEAIAGLLKNIFK

SEQ ID NO: 486 - protein, 15 aa, Artificial Sequence
  Description of Artificial Sequence: Synthetic peptide
CFFGAIAGLLKNIFK

SEQ ID NO: 487 - protein, 15 aa, Artificial Sequence
  Description of Artificial Sequence: Synthetic peptide
CFFEAIAGLLKNIFK

SEQ ID NO: 488 - protein, 16 aa, Artificial Sequence
  Description of Artificial Sequence: Synthetic peptide
CGFFEAIAGLLKNIFK

SEQ ID NO: 489 - protein, 18 aa, Artificial Sequence
  Description of Artificial Sequence: Synthetic peptide
  MOD_RES (1)..(18): D-amino acid
CIFGAIAGFIKNIWEGLI

SEQ ID NO: 490 - protein, 15 aa, Artificial Sequence
  Description of Artificial Sequence: Synthetic peptide
  MOD_RES (1)..(15): D-amino acid
CIFGAIAGLLKNIFK

SEQ ID NO: 491 - protein, 24 aa, Artificial Sequence
  Description of Artificial Sequence: Synthetic peptide
  MOD_RES (1)..(24): D-amino acid
CGLFGEIEELIEEGLENLIDWWNG

SEQ ID NO: 492 - protein, 24 aa, Artificial Sequence
  Description of Artificial Sequence: Synthetic peptide
  MOD_RES (1)..(24): D-amino acid
CGNFGEIEELIEEGLENLIDWWNG

SEQ ID NO: 493 - protein, 24 aa, Artificial Sequence
  Description of Artificial Sequence: Synthetic peptide
  MOD_RES (1)..(24): D-amino acid
CGFFGEIAELIEEGLKGLIDWWNG

SEQ ID NO: 494 - protein, 24 aa, Artificial Sequence
  Description of Artificial Sequence: Synthetic peptide
CGLFGEIEELIEEGLENLIDWWNE

SEQ ID NO: 495 - protein, 16 aa, Artificial Sequence
  Description of Artificial Sequence: Synthetic peptide
CGFFGAIAGLLKNIFK

SEQ ID NO: 496 - protein, 35 aa, Artificial Sequence
  Description of Artificial Sequence: Synthetic polypeptide
CGLFELIEGFIENGWEGMIDGWYGYGRKKRRQRRK

SEQ ID NO: 497 - protein, 35 aa, Artificial Sequence
  Description of Artificial Sequence: Synthetic polypeptide
CGLFELIEGFIEWGWEGMIDGWYGYGRKKRRQRRK

SEQ ID NO: 498 - protein, 35 aa, Artificial Sequence; identical to SEQ ID NO: 27
  Description of Artificial Sequence: Synthetic polypeptide

SEQ ID NO: 499 - protein, 35 aa, Artificial Sequence; identical to SEQ ID NO: 27
  Description of Artificial Sequence: Synthetic polypeptide

SEQ ID NO: 500 - protein, 19 aa, Artificial Sequence
  Description of Artificial Sequence: Synthetic peptide
CIFGAIAGFIKNIWEGLIK

SEQ ID NO: 501 - protein, 19 aa, Artificial Sequence
  Description of Artificial Sequence: Synthetic peptide
CIFGAIAGFIKNIWEGLIK

SEQ ID NO: 502 - protein, 35 aa, Artificial Sequence
  Description of Artificial Sequence: Synthetic polypeptide
CGLFEAIEGFIEWGWEGMIDGWYGYGRKKRRQRRK

SEQ ID NO: 503 - protein, 35 aa, Artificial Sequence; identical to SEQ ID NO: 502
  Description of Artificial Sequence: Synthetic polypeptide

SEQ ID NO: 504 - protein, 35 aa, Artificial Sequence; identical to SEQ ID NO: 496
  Description of Artificial Sequence: Synthetic polypeptide

SEQ ID NO: 505 - protein, 35 aa, Artificial Sequence; identical to SEQ ID NO: 496
  Description of Artificial Sequence: Synthetic polypeptide

SEQ ID NO: 506 - protein, 15 aa, Artificial Sequence
  Description of Artificial Sequence: Synthetic peptide
CFFGAIWEFIHSILK

SEQ ID NO: 507 - protein, 15 aa, Artificial Sequence
  Description of Artificial Sequence: Synthetic peptide
CFFGAIWEFIHSILK

SEQ ID NO: 508 - protein, 18 aa, Artificial Sequence
  Description of Artificial Sequence: Synthetic peptide
CIFGAIAGFIKNILKGLK

SEQ ID NO: 509 - protein, 18 aa, Artificial Sequence
  Description of Artificial Sequence: Synthetic peptide
CIFGAIAGFIKNILKGLK

SEQ ID NO: 510 - protein, 18 aa, Artificial Sequence
  Description of Artificial Sequence: Synthetic peptide
CFFGAIWEFIRNILEGFK

SEQ ID NO: 511 - protein, 18 aa, Artificial Sequence
  Description of Artificial Sequence: Synthetic peptide
CFFGAIWEFIRNILEGFK

SEQ ID NO: 512 - protein, 24 aa, Artificial Sequence
  Description of Artificial Sequence: Synthetic peptide
CGLFGEIEELIEEGLENLIDWWNQ

SEQ ID NO: 513 - protein, 16 aa, Artificial Sequence
  Description of Artificial Sequence: Synthetic peptide
CGIFGAIAGLLKSALK

SEQ ID NO: 514 - protein, 16 aa, Artificial Sequence
  Description of Artificial Sequence: Synthetic peptide
CGIFEAIAGLLKSIWK

SEQ ID NO: 515 - protein, 16 aa, Artificial Sequence
  Description of Artificial Sequence: Synthetic peptide
CGIFEAIAGLLKSILK

SEQ ID NO: 516 - protein, 16 aa, Artificial Sequence
  Description of Artificial Sequence: Synthetic peptide
  MOD_RES (12)..(12): Ornithine
CGIFEAIAGLLXNIFK

SEQ ID NO: 517 - protein, 24 aa, Artificial Sequence
  Description of Artificial Sequence: Synthetic peptide
CGIFEAIAGLLKNILKGLIDGWYG

SEQ ID NO: 518 - protein, 24 aa, Artificial Sequence
  Description of Artificial Sequence: Synthetic peptide
CGIFGAIAGLLKNILKGLIDGWYG

SEQ ID NO: 519 - protein, 24 aa, Artificial Sequence
  Description of Artificial Sequence: Synthetic peptide
CGIFGAIAGLLKNIFKGLIDGWYG

SEQ ID NO: 520 - protein, 16 aa, Artificial Sequence
  Description of Artificial Sequence: Synthetic peptide
CGIFGAIWELWEWILK

SEQ ID NO: 521 - protein, 16 aa, Artificial Sequence
  Description of Artificial Sequence: Synthetic peptide
CGIFEAIWELWEWILK

SEQ ID NO: 522 - protein, 25 aa, Artificial Sequence
  Description of Artificial Sequence: Synthetic peptide
CGLFEAIEGFIENGWEGMIDGWYGK

SEQ ID NO: 523 - protein, 24 aa, Artificial Sequence
  Description of Artificial Sequence: Synthetic peptide
GLFEAIEGFIENGWEGMIDGWYGC

SEQ ID NO: 524 - protein, 14 aa, Artificial Sequence
  Description of Artificial Sequence: Synthetic peptide
  MOD_RES (5)..(5): Aib
CFLEXLWKLLEHLL

SEQ ID NO: 525 - protein, 14 aa, Artificial Sequence
  Description of Artificial Sequence: Synthetic peptide
  MOD_RES (5)..(5): Aib
CFLEXLWELLEHLL

SEQ ID NO: 526 - protein, 14 aa, Artificial Sequence
  Description of Artificial Sequence: Synthetic peptide
  MOD_RES (9)..(9): Aib
CFLEALWEXLEHLL

SEQ ID NO: 527 - protein, 14 aa, Artificial Sequence
  Description of Artificial Sequence: Synthetic peptide
  MOD_RES (5)..(5): Aib
  MOD_RES (9)..(9): Aib
CFLEXLWEXLEHLL

SEQ ID NO: 528 - protein, 14 aa, Artificial Sequence
  Description of Artificial Sequence: Synthetic peptide
  MOD_RES (5)..(5): Aib
CFLEXLWEALEKLF

SEQ ID NO: 529 - protein, 18 aa, Artificial Sequence
  Description of Artificial Sequence: Synthetic peptide
IFGAIAGFIKNIWEGLIC

SEQ ID NO: 530 - protein, 19 aa, Artificial Sequence
  Description of Artificial Sequence: Synthetic peptide
CIFGAIAGFIKNIWEGLIK

SEQ ID NO: 531 - protein, 14 aa, Artificial Sequence
  Description of Artificial Sequence: Synthetic peptide
FFGAIWEFIKSILC

SEQ ID NO: 532 - protein, 15 aa, Artificial Sequence
  Description of Artificial Sequence: Synthetic peptide
CFFGAIWEFIKSILK

SEQ ID NO: 533 - protein, 14 aa, Artificial Sequence
  Description of Artificial Sequence: Synthetic peptide
FFGAIWEFIHSILC

SEQ ID NO: 534 - protein, 15 aa, Artificial Sequence
  Description of Artificial Sequence: Synthetic peptide
CFFGAIWEFIHSILK

SEQ ID NO: 535 - protein, 16 aa, Artificial Sequence
  Description of Artificial Sequence: Synthetic peptide
GIFEAIAGLLKNIFKC

SEQ ID NO: 536 - protein, 16 aa, Artificial Sequence
  Description of Artificial Sequence: Synthetic peptide
CGIFEAIAGLLKNIFK

SEQ ID NO: 537 - protein, 17 aa, Artificial Sequence
  Description of Artificial Sequence: Synthetic peptide
CGIFEAIAGLLKNIFKK

SEQ ID NO: 538 - protein, 17 aa, Artificial Sequence
  Description of Artificial Sequence: Synthetic peptide
IFGAIAGFIKNILKGLC

SEQ ID NO: 539 - protein, 18 aa, Artificial Sequence
  Description of Artificial Sequence: Synthetic peptide
CIFGAIAGFIKNILKGLK

SEQ ID NO: 540 - protein, 17 aa, Artificial Sequence
  Description of Artificial Sequence: Synthetic peptide
CIFGAIAGFIKNILKGL

SEQ ID NO: 541 - protein, 24 aa, Artificial Sequence
  Description of Artificial Sequence: Synthetic peptide
CGLFGEIEELIEEGLENLIDWWNS

SEQ ID NO: 542 - protein, 34 aa, Artificial Sequence; identical to SEQ ID NO: 32
  Description of Artificial Sequence: Synthetic polypeptide

SEQ ID NO: 543 - protein, 24 aa, Artificial Sequence
  Description of Artificial Sequence: Synthetic peptide
CGFFGEIAELIEEGLKNLIDWWNG

SEQ ID NO: 544 - protein, 34 aa, Artificial Sequence; identical to SEQ ID NO: 228
  Description of Artificial Sequence: Synthetic polypeptide

SEQ ID NO: 545 - protein, 34 aa, Artificial Sequence; identical to SEQ ID NO: 5
  Description of Artificial Sequence: Synthetic polypeptide

SEQ ID NO: 546 - protein, 34 aa, Artificial Sequence; identical to SEQ ID NO: 13
  Description of Artificial Sequence: Synthetic polypeptide

SEQ ID NO: 547 - protein, 18 aa, Artificial Sequence
  Description of Artificial Sequence: Synthetic peptide
CIFGAIAGFIKNIWEGLI

SEQ ID NO: 548 - protein, 24 aa, Artificial Sequence
  Description of Artificial Sequence: Synthetic peptide
CGLFGEIEELIEEGLENLIDWWNG

SEQ ID NO: 549 - protein, 34 aa, Artificial Sequence
  Description of Artificial Sequence: Synthetic polypeptide
CGLFEEIEGFIENGWEGLIDWWYGYGHKKGGQHR

SEQ ID NO: 550 - protein, 35 aa, Artificial Sequence; identical to SEQ ID NO: 27
  Description of Artificial Sequence: Synthetic polypeptide

SEQ ID NO: 551 - protein, 30 aa, Artificial Sequence
  Description of Artificial Sequence: Synthetic polypeptide
CGLFEALLELLESLWELLEAYGRKKRRQRR

SEQ ID NO: 552 - protein, 30 aa, Artificial Sequence; identical to SEQ ID NO: 551
  Description of Artificial Sequence: Synthetic polypeptide

SEQ ID NO: 553 - protein, 17 aa, Artificial Sequence
  Description of Artificial Sequence: Synthetic peptide
CFFGAIWEFIRNILEGF

SEQ ID NO: 554 - protein, 18 aa, Artificial Sequence
  Description of Artificial Sequence: Synthetic peptide
CFFGAIWEFIRNILEGFK

SEQ ID NO: 555 - protein, 19 aa, Artificial Sequence
  Description of Artificial Sequence: Synthetic peptide
CIFGAIAGFIKNIWEGLIK

SEQ ID NO: 556 - protein, 14 aa, Artificial Sequence
  Description of Artificial Sequence: Synthetic peptide
FFGAIWEFIKSILC

SEQ ID NO: 557 - protein, 15 aa, Artificial Sequence
  Description of Artificial Sequence: Synthetic peptide
CFFGAIWEFIKSILK

SEQ ID NO: 558 - protein, 14 aa, Artificial Sequence
  Description of Artificial Sequence: Synthetic peptide
FFGAIWEFIHSILC

SEQ ID NO: 559 - protein, 15 aa, Artificial Sequence
  Description of Artificial Sequence: Synthetic peptide
CFFGAIWEFIHSILK

SEQ ID NO: 560 - protein, 16 aa, Artificial Sequence
  Description of Artificial Sequence: Synthetic peptide
GIFEAIAGLLKNIFKC

SEQ ID NO: 561 - protein, 16 aa, Artificial Sequence
  Description of Artificial Sequence: Synthetic peptide
CGIFEAIAGLLKNIFK

SEQ ID NO: 562 - protein, 18 aa, Artificial Sequence
  Description of Artificial Sequence: Synthetic peptide
CFFGAIWEFIRNILEGFK

SEQ ID NO: 563 - protein, 24 aa, Artificial Sequence
  Description of Artificial Sequence: Synthetic peptide
GLFEAIEGFIENGWEGMIDGWYGC

SEQ ID NO: 564 - protein, 25 aa, Artificial Sequence
  Description of Artificial Sequence: Synthetic peptide
CGLFEAIEGFIENGWEGMIDGWYGK

SEQ ID NO: 565 - protein, 26 aa, Artificial Sequence
  Description of Artificial Sequence: Synthetic peptide
CGKFTIVFPHNQKGNWKNVPSNYHYK

SEQ ID NO: 566 - protein, 26 aa, Artificial Sequence
  Description of Artificial Sequence: Synthetic peptide
CMDGTLFPGDDDLAIPATEFFSTKAK

SEQ ID NO: 567 - protein, 26 aa, Artificial Sequence
  Description of Artificial Sequence: Synthetic peptide
CNPVENYIDEVLNEVLVVPNINSSNK

SEQ ID NO: 568 - protein, 22 aa, Artificial Sequence
  Description of Artificial Sequence: Synthetic peptide
CVTPHHVLVDEYTGEWVDSQFK

SEQ ID NO: 569 - protein, 30 aa, Artificial Sequence
  Description of Artificial Sequence: Synthetic polypeptide
CIFGIDDLIIGLLFVAIVEAGIGGYLLGSK

SEQ ID NO: 570 - protein, 19 aa, Artificial Sequence
  Description of Artificial Sequence: Synthetic peptide
CGAAIGLAWIPYFGPAAEK

SEQ ID NO: 571 - protein, 28 aa, Artificial Sequence
  Description of Artificial Sequence: Synthetic peptide
CFAGVVLAGAALGVATAAQITAGIALHK

SEQ ID NO: 572 - protein, 26 aa, Artificial Sequence
  Description of Artificial Sequence: Synthetic peptide
CFLGFLLGVGSAIASGIAVSKVLHLK

SEQ ID NO: 573 - protein, 28 aa, Artificial Sequence
  Description of Artificial Sequence: Synthetic peptide
CFFGAVIGTIALGVATSAQITAGIALAK

SEQ ID NO: 574 - protein, 28 aa, Artificial Sequence
  Description of Artificial Sequence: Synthetic peptide
CFFGAVIGTIALGVATAAQITAGIALAK

SEQ ID NO: 575 - protein, 24 aa, Artificial Sequence
  Description of Artificial Sequence: Synthetic peptide
GLFEAIAGFIENGGWEGMIDGGGK

SEQ ID NO: 576 - protein, 24 aa, Artificial Sequence
  Description of Artificial Sequence: Synthetic peptide
GLFKAIAKFIKGGWKGLIKGWYGK

SEQ ID NO: 577 - protein, 24 aa, Artificial Sequence
  Description of Artificial Sequence: Synthetic peptide
GLFHAIAHFIHGGWHGLIHGWYGK

SEQ ID NO: 578 - protein, 25 aa, Artificial Sequence
  Description of Artificial Sequence: Synthetic peptide
CGLFEAIAEFIENGWEGLIEGWYGK

SEQ ID NO: 579 - protein, 25 aa, Artificial Sequence
  Description of Artificial Sequence: Synthetic peptide
CGFFGAIAGFLEGGWEGMIAGWHGK

SEQ ID NO: 580 - protein, 29 aa, Artificial Sequence
  Description of Artificial Sequence: Synthetic peptide
CFAGVVIGLAALGVATAAQVTAAVALVKK

SEQ ID NO: 581 - protein, 33 aa, Artificial Sequence
  Description of Artificial Sequence: Synthetic polypeptide
CAVGIVGAMFLGFLGAAGSTMGAVSLTLTVQAK

SEQ ID NO: 582 - protein, 29 aa, Artificial Sequence
  Description of Artificial Sequence: Synthetic peptide
CGVFVLGFLGFLATAGSAMGARSLTLSAK

SEQ ID NO: 583 - protein, 29 aa, Artificial Sequence
  Description of Artificial Sequence: Synthetic peptide
CVPFVLGFLGFLGAAGTAMGAAATALTVK

SEQ ID NO: 584 - protein, 33 aa, Artificial Sequence
  Description of Artificial Sequence: Synthetic polypeptide
CAVPVAVWLVSALAMGAGVAGGITGSMSLASGK

SEQ ID NO: 585 - protein, 21 aa, Artificial Sequence
  Description of Artificial Sequence: Synthetic peptide
CGLASTLTRWAHYNALIRAFK

SEQ ID NO: 586 - protein, 22 aa, Artificial Sequence
  Description of Artificial Sequence: Synthetic peptide
CGPVEDAITAAIGRVADTVGTK

SEQ ID NO: 587 - protein, 22 aa, Artificial Sequence
  Description of Artificial Sequence: Synthetic peptide
CGLGQMLESMIDNTVREVGGAK

SEQ ID NO: 588 - protein, 26 aa, Artificial Sequence
  Description of Artificial Sequence: Synthetic peptide
CGLFEAIEGFIENGWEGMIDGWYGFK

SEQ ID NO: 589 - protein, 34 aa, Artificial Sequence; identical to SEQ ID NO: 32
  Description of Artificial Sequence: Synthetic polypeptide
  MOD_RES (1)..(3): D-amino acid
  MOD_RES (32)..(34): D-amino acid

SEQ ID NO: 590 - protein, 35 aa, Artificial Sequence
  Description of Artificial Sequence: Synthetic polypeptide
  MOD_RES (3)..(4): D-amino acid
CGLFLEAIEGFIENGWEGMIDGWYGYGRKKRRQRR

SEQ ID NO: 591 - protein, 29 aa, Artificial Sequence
  Description of Artificial Sequence: Synthetic peptide
CIFGIDDLIIGLLFVAIVEAGIGGYLLGS

SEQ ID NO: 592 - protein, 16 aa, Artificial Sequence
  Description of Artificial Sequence: Synthetic peptide
CVTVLALGALAGVGVG

SEQ ID NO: 593 - protein, 25 aa, Artificial Sequence
  Description of Artificial Sequence: Synthetic peptide
CLLGRRGWEVLKYWWNLLQYWSQEL

SEQ ID NO: 594 - protein, 16 aa, Artificial Sequence
  Description of Artificial Sequence: Synthetic peptide
CGIFEAIAGLLKNIFD

SEQ ID NO: 595 - protein, 16 aa, Artificial Sequence
  Description of Artificial Sequence: Synthetic peptide
CGIFEAIAGLLKNIFE

SEQ ID NO: 596 - protein, 16 aa, Artificial Sequence
  Description of Artificial Sequence: Synthetic peptide
CGIFEAIAGLLKNIFR

SEQ ID NO: 597 - protein, 16 aa, Artificial Sequence
  Description of Artificial Sequence: Synthetic peptide
CGIFEAIAGLLKNIFH

SEQ ID NO: 598 - protein, 16 aa, Artificial Sequence
  Description of Artificial Sequence: Synthetic peptide
  MOD_RES (16)..(16): Ornithine
CGIFEAIAGLLKNIFX

SEQ ID NO: 599 - protein, 16 aa, Artificial Sequence
  Description of Artificial Sequence: Synthetic peptide
CGIFEAIAGLLKNIFN

SEQ ID NO: 600 - protein, 16 aa, Artificial Sequence
  Description of Artificial Sequence: Synthetic peptide
  MOD_RES (16)..(16): Cit
CGIFEAIAGLLKNIFX

SEQ ID NO: 601 - protein, 16 aa, Artificial Sequence
  Description of Artificial Sequence: Synthetic peptide
CGIFGAIWGLLKNIFK

SEQ ID NO: 602 - protein, 15 aa, Artificial Sequence
  Description of Artificial Sequence: Synthetic peptide
CIFEAIAGLLKNIFK

SEQ ID NO: 603 - protein, 15 aa, Artificial Sequence
  Description of Artificial Sequence: Synthetic peptide
CFFEAIAGLLKNIFK

SEQ ID NO: 604 - protein, 16 aa, Artificial Sequence
  Description of Artificial Sequence: Synthetic peptide
CGFFEAIAGLLKNIFK

SEQ ID NO: 605 - protein, 17 aa, Artificial Sequence
  Description of Artificial Sequence: Synthetic peptide
CGIFEAIAGLLKNIFKG

SEQ ID NO: 606 - protein, 18 aa, Artificial Sequence
  Description of Artificial Sequence: Synthetic peptide
CGIFEAIAGLLKNIFKGL

SEQ ID NO: 607 - protein, 19 aa, Artificial Sequence
  Description of Artificial Sequence: Synthetic peptide
CGIFEAIAGLLKNIFKGLI

SEQ ID NO: 608 - protein, 20 aa, Artificial Sequence
  Description of Artificial Sequence: Synthetic peptide
CGIFEAIAGLLKNIFKGLID

SEQ ID NO: 609 - protein, 21 aa, Artificial Sequence
  Description of Artificial Sequence: Synthetic peptide
CGIFEAIAGLLKNIFKGLIDG

SEQ ID NO: 610 - protein, 22 aa, Artificial Sequence
  Description of Artificial Sequence: Synthetic peptide
CGIFEAIAGLLKNIFKGLIDGF

SEQ ID NO: 611 - protein, 24 aa, Artificial Sequence
  Description of Artificial Sequence: Synthetic peptide
CGIFEAIAGLLKNIFKGLIDGWYG

SEQ ID NO: 612 - protein, 16 aa, Artificial Sequence
  Description of Artificial Sequence: Synthetic peptide
  MOD_RES (1)..(16): D-amino acid
CGIFEAIAGLLKNIFK

SEQ ID NO: 613 - protein, 16 aa, Artificial Sequence
  Description of Artificial Sequence: Synthetic peptide
CGIFEAIAGLLKSILK

SEQ ID NO: 614 - protein, 17 aa, Artificial Sequence
  Description of Artificial Sequence: Synthetic peptide
CGIFEAIAGLLKNIFKA

SEQ ID NO: 615 - protein, 17 aa, Artificial Sequence
  Description of Artificial Sequence: Synthetic peptide
CGIFEAIAGLLKNIFKL

SEQ ID NO: 616 - protein, 17 aa, Artificial Sequence
  Description of Artificial Sequence: Synthetic peptide
CGIFEAIAGLLKNIFKW

SEQ ID NO: 617 - protein, 17 aa, Artificial Sequence
  Description of Artificial Sequence: Synthetic peptide
CGIFEAIAGLLKNIFKF

SEQ ID NO: 618 - protein, 16 aa, Artificial Sequence
  Description of Artificial Sequence: Synthetic peptide
CGIFEAIAGLLKNAFK

SEQ ID NO: 619 - protein, 16 aa, Artificial Sequence
  Description of Artificial Sequence: Synthetic peptide
CGIFGAIAGLLKNAFK

SEQ ID NO: 620 - protein, 16 aa, Artificial Sequence
  Description of Artificial Sequence: Synthetic peptide
  MOD_RES (12)..(12): Ornithine
  MOD_RES (16)..(16): Ornithine
CGIFEAIAGLLXNIFX

SEQ ID NO: 621 - protein, 31 aa, Artificial Sequence
  Description of Artificial Sequence: Synthetic polypeptide
CGIFEAIAGLLKNIFKGIFEAIAGLLKNIFK

SEQ ID NO: 622 - protein, 29 aa, Artificial Sequence
  Description of Artificial Sequence: Synthetic peptide
CGIFEAIAGLLKNIFKFFGAIWEFIHSIL

SEQ ID NO: 623 - protein, 29 aa, Artificial Sequence
  Description of Artificial Sequence: Synthetic peptide
CFFGAIWEFIHSILGIFEAIAGLLKNIFK

SEQ ID NO: 624 - protein, 27 aa, Artificial Sequence
  Description of Artificial Sequence: Synthetic peptide
CFFGAIWEFIHSILFFGAIWEFIHSIL

SEQ ID NO: 625 - protein, 28 aa, Artificial Sequence
  Description of Artificial Sequence: Synthetic peptide
CFFGAIWEFIHSILGFFGAIWEFIHSIL

SEQ ID NO: 626 - protein, 31 aa, Artificial Sequence; identical to SEQ ID NO: 621
  Description of Artificial Sequence: Synthetic polypeptide

SEQ ID NO: 627 - protein, 29 aa, Artificial Sequence
  Description of Artificial Sequence: Synthetic peptide
CGIFEAIAGLLKNIFKFFGAIWEFIHSIL

SEQ ID NO: 628 - protein, 29 aa, Artificial Sequence
  Description of Artificial Sequence: Synthetic peptide
CFFGAIWEFIHSILGIFEAIAGLLKNIFK

SEQ ID NO: 629 - protein, 21 aa, Artificial Sequence
  Description of Artificial Sequence: Synthetic peptide
CGLFHALLHLLHSLWHLLLEA

SEQ ID NO: 630 - protein, 22 aa, Artificial Sequence
  Description of Artificial Sequence: Synthetic peptide
CGLFHALLHLLHSLWHLLLEAK

SEQ ID NO: 631 - protein, 22 aa, Artificial Sequence
  Description of Artificial Sequence: Synthetic peptide
CGLFHALLHLLHSLWHLLLEAK

SEQ ID NO: 632 - protein, 21 aa, Artificial Sequence
  Description of Artificial Sequence: Synthetic peptide
GLFHALLHLLHSLWHLLLEAC

SEQ ID NO: 633 - protein, 14 aa, Artificial Sequence
  Description of Artificial Sequence: Synthetic peptide
CFFGNIWEFIKSIL

SEQ ID NO: 634 - protein, 14 aa, Artificial Sequence
  Description of Artificial Sequence: Synthetic peptide
CFFGAIWLFIKSIL

SEQ ID NO: 635 - protein, 14 aa, Artificial Sequence
  Description of Artificial Sequence: Synthetic peptide
CFFGAIWNFIKSIL

SEQ ID NO: 636 - protein, 14 aa, Artificial Sequence
  Description of Artificial Sequence: Synthetic peptide
CFFGAIWGFIKSIL

SEQ ID NO: 637 - protein, 14 aa, Artificial Sequence
  Description of Artificial Sequence: Synthetic peptide
CFLGALFKALSKLL

SEQ ID NO: 638 - protein, 14 aa, Artificial Sequence
  Description of Artificial Sequence: Synthetic peptide
CFLGALFHALSKLL

SEQ ID NO: 639 - protein, 14 aa, Artificial Sequence
  Description of Artificial Sequence: Synthetic peptide
CFLGALFKALSHLL

SEQ ID NO: 640 - protein, 14 aa, Artificial Sequence
  Description of Artificial Sequence: Synthetic peptide
CFLGALFHALSHLL

SEQ ID NO: 641 - protein, 14 aa, Artificial Sequence
  Description of Artificial Sequence: Synthetic peptide
FLGALFKALSKLLC

SEQ ID NO: 642 - protein, 14 aa, Artificial Sequence
  Description of Artificial Sequence: Synthetic peptide
FLGALFHALSKLLC

SEQ ID NO: 643 - protein, 14 aa, Artificial Sequence
  Description of Artificial Sequence: Synthetic peptide
FLGALFKALSHLLC

SEQ ID NO: 644 - protein, 14 aa, Artificial Sequence
  Description of Artificial Sequence: Synthetic peptide
FLGALFHALSHLLC

SEQ ID NO: 645 - protein, 14 aa, Artificial Sequence
  Description of Artificial Sequence: Synthetic peptide
CFLGALFKALKSLL

SEQ ID NO: 646 - protein, 14 aa, Artificial Sequence
  Description of Artificial Sequence: Synthetic peptide
CFLGALFHALKSLL

SEQ ID NO: 647 - protein, 14 aa, Artificial Sequence
  Description of Artificial Sequence: Synthetic peptide
CFLGALFKALHSLL

SEQ ID NO: 648 - protein, 14 aa, Artificial Sequence
  Description of Artificial Sequence: Synthetic peptide
CFLGALFHALHSLL

SEQ ID NO: 649 - protein, 14 aa, Artificial Sequence
  Description of Artificial Sequence: Synthetic peptide
FLGALFKALKSLLC

SEQ ID NO: 650 - protein, 14 aa, Artificial Sequence
  Description of Artificial Sequence: Synthetic peptide
FLGALFHALKSLLC

SEQ ID NO: 651 - protein, 14 aa, Artificial Sequence
  Description of Artificial Sequence: Synthetic peptide
FLGALFKALHSLLC

SEQ ID NO: 652 - protein, 14 aa, Artificial Sequence
  Description of Artificial Sequence: Synthetic peptide
FLGALFHALHSLLC

SEQ ID NO: 653 - protein, 21 aa, Artificial Sequence
  Description of Artificial Sequence: Synthetic peptide
CGIFGAIAGFIKNIWKGLIDW

SEQ ID NO: 654 - protein, 34 aa, Artificial Sequence; identical to SEQ ID NO: 19
  Description of Artificial Sequence: Synthetic polypeptide
  MOD_RES (18)..(18): Nle

SEQ ID NO: 655 - protein, 34 aa, Artificial Sequence; identical to SEQ ID NO: 4
  Description of Artificial Sequence: Synthetic polypeptide

SEQ ID NO: 656 - protein, 34 aa, Artificial Sequence; identical to SEQ ID NO: 42
  Description of Artificial Sequence: Synthetic polypeptide

SEQ ID NO: 657 - protein, 34 aa, Artificial Sequence; identical to SEQ ID NO: 43
  Description of Artificial Sequence: Synthetic polypeptide

SEQ ID NO: 658 - protein, 19 aa, Artificial Sequence
  Description of Artificial Sequence: Synthetic peptide
CRLLRLLLRLWRRLLRLLR

SEQ ID NO: 659 - protein, 33 aa, Artificial Sequence; identical to SEQ ID NO: 88
  Description of Artificial Sequence: Synthetic polypeptide

SEQ ID NO: 660 - protein, 14 aa, Artificial Sequence
  Description of Artificial Sequence: Synthetic peptide
CFFGAIWEFAHGIL

SEQ ID NO: 661 - protein, 17 aa, Artificial Sequence
  Description of Artificial Sequence: Synthetic peptide
CFFGAIWEFARGILEGF

SEQ ID NO: 662 - protein, 14 aa, Artificial Sequence
  Description of Artificial Sequence: Synthetic peptide
FFGAIWEFAHGILC

SEQ ID NO: 663 - protein, 17 aa, Artificial Sequence
  Description of Artificial Sequence: Synthetic peptide
FFGAIWEFARGILEGFC

SEQ ID NO: 664 - protein, 14 aa, Artificial Sequence
  Description of Artificial Sequence: Synthetic peptide
CFFGAIWEFAHSIL

SEQ ID NO: 665 - protein, 14 aa, Artificial Sequence
  Description of Artificial Sequence: Synthetic peptide
FFGAIWEFAHSILC

SEQ ID NO: 666 - protein, 15 aa, Artificial Sequence
  Description of Artificial Sequence: Synthetic peptide
CFFGAIWEFARSILK

SEQ ID NO: 667 - protein, 15 aa, Artificial Sequence
  Description of Artificial Sequence: Synthetic peptide
FFGAIWEFARSILKC

SEQ ID NO: 668 - protein, 16 aa, Artificial Sequence
  Description of Artificial Sequence: Synthetic peptide
CGIFEAIAGLAKNIFK

SEQ ID NO: 669 - protein, 16 aa, Artificial Sequence
  Description of Artificial Sequence: Synthetic peptide
GIFEAIAGLAKNIFKC

SEQ ID NO: 670 - protein, 16 aa, Artificial Sequence
  Description of Artificial Sequence: Synthetic peptide
CGIFEAIAGLAKNIFH

SEQ ID NO: 671 - protein, 16 aa, Artificial Sequence
  Description of Artificial Sequence: Synthetic peptide
CGIFEAIAGLAHNIFH

SEQ ID NO: 672 - protein, 16 aa, Artificial Sequence
  Description of Artificial Sequence: Synthetic peptide
CGIFEAIAGLAHNIFK

SEQ ID NO: 673 - protein, 16 aa, Artificial Sequence
  Description of Artificial Sequence: Synthetic peptide
GIFEAIAGLAKNIFHC

SEQ ID NO: 674 - protein, 16 aa, Artificial Sequence
  Description of Artificial Sequence: Synthetic peptide
GIFEAIAGLAHNIFHC

SEQ ID NO: 675 - protein, 14 aa, Artificial Sequence
  Description of Artificial Sequence: Synthetic peptide
CFLGALWKALSKLL

SEQ ID NO: 676 - protein, 14 aa, Artificial Sequence
  Description of Artificial Sequence: Synthetic peptide
CFLGALWHALSKLL

SEQ ID NO: 677 - protein, 14 aa, Artificial Sequence
  Description of Artificial Sequence: Synthetic peptide
CFLGALWKALSHLL

SEQ ID NO: 678 - protein, 14 aa, Artificial Sequence
  Description of Artificial Sequence: Synthetic peptide
CFLGALWHALSHLL

SEQ ID NO: 679 - protein, 14 aa, Artificial Sequence
  Description of Artificial Sequence: Synthetic peptide
FLGALWKALSKLLC

SEQ ID NO: 680 - protein, 14 aa, Artificial Sequence
  Description of Artificial Sequence: Synthetic peptide
FLGALWHALSKLLC

SEQ ID NO: 681 - protein, 14 aa, Artificial Sequence
  Description of Artificial Sequence: Synthetic peptide
FLGALWKALSHLLC

SEQ ID NO: 682 - protein, 14 aa, Artificial Sequence
  Description of Artificial Sequence: Synthetic peptide
FLGALWHALSHLLC

SEQ ID NO: 683 - protein, 16 aa, Artificial Sequence
  Description of Artificial Sequence: Synthetic peptide
CGIFGAIAGLLKNAFK

SEQ ID NO: 684 - protein, 15 aa, Artificial Sequence
  Description of Artificial Sequence: Synthetic peptide
CIFEAIAGLLKNAFK

SEQ ID NO: 685 - protein, 15 aa, Artificial Sequence
  Description of Artificial Sequence: Synthetic peptide
CIFGAIAGLLKNAFK

SEQ ID NO: 686 - protein, 14 aa, Artificial Sequence
  Description of Artificial Sequence: Synthetic peptide
CIFEAIWEFIKNIW

SEQ ID NO: 687 - protein, 14 aa, Artificial Sequence
  Description of Artificial Sequence: Synthetic peptide
CIFEAIAEFIKNIW

SEQ ID NO: 688 - protein, 14 aa, Artificial Sequence
  Description of Artificial Sequence: Synthetic peptide
CIFGAIWEFIKNIW

SEQ ID NO: 689 - protein, 14 aa, Artificial Sequence
  Description of Artificial Sequence: Synthetic peptide
CIFGAIAEFIKNIW

SEQ ID NO: 690 - protein, 15 aa, Artificial Sequence
  Description of Artificial Sequence: Synthetic peptide
CGIFGIAIGFKINIW

SEQ ID NO: 691 - protein, 16 aa, Artificial Sequence
  Description of Artificial Sequence: Synthetic peptide
CGIFEAIAGLLHNIFK

SEQ ID NO: 692 - protein, 16 aa, Artificial Sequence
  Description of Artificial Sequence: Synthetic peptide
CGIFEAIWGLLHNIFK

SEQ ID NO: 693 - protein, 16 aa, Artificial Sequence
  Description of Artificial Sequence: Synthetic peptide
CGFFEAIAGLLHNIFK

SEQ ID NO: 694 - protein, 16 aa, Artificial Sequence
  Description of Artificial Sequence: Synthetic peptide
CGIFEAIAALLKNIFK

SEQ ID NO: 695 - protein, 16 aa, Artificial Sequence
  Description of Artificial Sequence: Synthetic peptide
CGIFEAIEGLLKNIFK

SEQ ID NO: 696 - protein, 16 aa, Artificial Sequence
  Description of Artificial Sequence: Synthetic peptide
CGIFEAIAGFFKNIFK

SEQ ID NO: 697 - protein, 16 aa, Artificial Sequence
  Description of Artificial Sequence: Synthetic peptide
CGIFEAIAGWWKNIFK

SEQ ID NO: 698 - protein, 16 aa, Artificial Sequence
  Description of Artificial Sequence: Synthetic peptide
CGIFEAIAGLLKNIWK

SEQ ID NO: 699 - protein, 16 aa, Artificial Sequence
  Description of Artificial Sequence: Synthetic peptide
CGIFEAIAELLKNIFK

SEQ ID NO: 700 - protein, 16 aa, Artificial Sequence
  Description of Artificial Sequence: Synthetic peptide
CGIFGAIAGLLKSALK

SEQ ID NO: 701 - protein, 16 aa, Artificial Sequence
  Description of Artificial Sequence: Synthetic peptide
CGIFEAIAGLLKSIWK

SEQ ID NO: 702 - protein, 16 aa, Artificial Sequence
  Description of Artificial Sequence: Synthetic peptide
CGIFEAIAGLLKSILK

SEQ ID NO: 703 - protein, 21 aa, Artificial Sequence
  Description of Artificial Sequence: Synthetic peptide
CGIFEAIAGLLKNIFKGLIDA

SEQ ID NO: 704 - protein, 22 aa, Artificial Sequence
  Description of Artificial Sequence: Synthetic peptide
CGIFEAIAGLLKNIFKGLIDAF

SEQ ID NO: 705 - protein, 24 aa, Artificial Sequence
  Description of Artificial Sequence: Synthetic peptide
CGIFEAIAGLLKNIFKGLIDAWYG

SEQ ID NO: 706 - protein, 25 aa, Artificial Sequence
  Description of Artificial Sequence: Synthetic peptide
CGIFEAIAGLLKNIFKGLIDAWYGF

SEQ ID NO: 707 - protein, 25 aa, Artificial Sequence
  Description of Artificial Sequence: Synthetic peptide
CGIFEAIAGLLKNIFKGLIDGWYGF

SEQ ID NO: 708 - protein, 21 aa, Artificial Sequence
  Description of Artificial Sequence: Synthetic peptide
CGIFEAIAGLLKNIFKGLIDW

SEQ ID NO: 709 - protein, 22 aa, Artificial Sequence
  Description of Artificial Sequence: Synthetic peptide
CGIFEAIAGLLKNIFKGLIDWF

SEQ ID NO: 710 - protein, 24 aa, Artificial Sequence
  Description of Artificial Sequence: Synthetic peptide
CGIFEAIAGLLKNIFKGLIDWWYG

SEQ ID NO: 711 - protein, 25 aa, Artificial Sequence
  Description of Artificial Sequence: Synthetic peptide
CGIFEAIAGLLKNIFKGLIDWWYGF

SEQ ID NO: 712 - protein, 16 aa, Artificial Sequence
  Description of Artificial Sequence: Synthetic peptide
CGIFELIAGLLKNIFK

SEQ ID NO: 713 - protein, 16 aa, Artificial Sequence
  Description of Artificial Sequence: Synthetic peptide
CGIFEAIAGLLKWIFK

SEQ ID NO: 714 - protein, 16 aa, Artificial Sequence
  Description of Artificial Sequence: Synthetic peptide
CGIFELIAGLLKWIFK

SEQ ID NO: 715 - protein, 17 aa, Artificial Sequence
  Description of Artificial Sequence: Synthetic peptide
CGIFELIAGLLKNIFKG

SEQ ID NO: 716 - protein, 17 aa, Artificial Sequence
  Description of Artificial Sequence: Synthetic peptide
CGIFEAIAGLLKWIFKG

SEQ ID NO: 717 - protein, 17 aa, Artificial Sequence
  Description of Artificial Sequence: Synthetic peptide
CGIFELIAGLLKWIFKG

SEQ ID NO: 718 - protein, 16 aa, Artificial Sequence
  Description of Artificial Sequence: Synthetic peptide
CGLFEALLGLLESLWK

SEQ ID NO: 719 - protein, 16 aa, Artificial Sequence
  Description of Artificial Sequence: Synthetic peptide
CGIFEAIAELLKNIFK

SEQ ID NO: 720 - protein, 16 aa, Artificial Sequence
  Description of Artificial Sequence: Synthetic peptide
CGIFEALLGLLKSLWK

SEQ ID NO: 721 - protein, 16 aa, Artificial Sequence
  Description of Artificial Sequence: Synthetic peptide
CGIFEALLELLKSLWK

SEQ ID NO: 722 - protein, 16 aa, Artificial Sequence
  Description of Artificial Sequence: Synthetic peptide
CGIFEAIAGLLKNIFK

SEQ ID NO: 723 - protein, 16 aa, Artificial Sequence
  Description of Artificial Sequence: Synthetic peptide
CEIFEAIAGLLKNIFK

SEQ ID NO: 724 - protein, 16 aa, Artificial Sequence
  Description of Artificial Sequence: Synthetic peptide
CEIFGAIAGLLKNIFK

SEQ ID NO: 725 - protein, 16 aa, Artificial Sequence
  Description of Artificial Sequence: Synthetic peptide
CGLFEAIAGLLKNLFK

SEQ ID NO: 726 - protein, 16 aa, Artificial Sequence
  Description of Artificial Sequence: Synthetic peptide
CGIWEAIAGLLKNIWK

SEQ ID NO: 727 - protein, 16 aa, Artificial Sequence
  Description of Artificial Sequence: Synthetic peptide
CGLFGAIAGLLKNLFK

SEQ ID NO: 728 - protein, 16 aa, Artificial Sequence
  Description of Artificial Sequence: Synthetic peptide
CGIWGAIAGLLKNIWK

SEQ ID NO: 729 - protein, 16 aa, Artificial Sequence
  Description of Artificial Sequence: Synthetic peptide
CGIFDAIAGLLKNIFK

SEQ ID NO: 730 - protein, 16 aa, Artificial Sequence
  Description of Artificial Sequence: Synthetic peptide
CGIFDAIWGLLKNIFK

SEQ ID NO: 731 - protein, 16 aa, Artificial Sequence
  Description of Artificial Sequence: Synthetic peptide
CGIFGGIGGLLKNIFK

SEQ ID NO: 732 - protein, 16 aa, Artificial Sequence
  Description of Artificial Sequence: Synthetic peptide
CAIFAAIAALLKNIFK

SEQ ID NO: 733 - protein, 15 aa, Artificial Sequence
  Description of Artificial Sequence: Synthetic peptide
CGIFEAIAGLLKNIF

SEQ ID NO: 734 - protein, 14 aa, Artificial Sequence
  Description of Artificial Sequence: Synthetic peptide
CGIFEAIAGLLKNI

SEQ ID NO: 735 - protein, 13 aa, Artificial Sequence
  Description of Artificial Sequence: Synthetic peptide
CGIFEAIAGLLKN

SEQ ID NO: 736 - protein, 12 aa, Artificial Sequence
  Description of Artificial Sequence: Synthetic peptide
CGIFEAIAGLLK

SEQ ID NO: 737 - protein, 16 aa, Artificial Sequence
  Description of Artificial Sequence: Synthetic peptide
CVIFEAIAGLLKNIFK

SEQ ID NO: 738 - protein, 16 aa, Artificial Sequence
  Description of Artificial Sequence: Synthetic peptide
CSIFEAIAGLLKNIFK

SEQ ID NO: 739 - protein, 16 aa, Artificial Sequence
  Description of Artificial Sequence: Synthetic peptide
CGIFEEIAGLLKNIFK

SEQ ID NO: 740 - protein, 16 aa, Artificial Sequence
  Description of Artificial Sequence: Synthetic peptide
CGIFEEIWGLLKNIFK

SEQ ID NO: 741 - protein, 16 aa, Artificial Sequence
  Description of Artificial Sequence: Synthetic peptide
CGIFEAIEELLKNIFK

SEQ ID NO: 742 - protein, 16 aa, Artificial Sequence
  Description of Artificial Sequence: Synthetic peptide
CGIFEAIAGLWKNIFK

SEQ ID NO: 743 - protein, 16 aa, Artificial Sequence
  Description of Artificial Sequence: Synthetic peptide
CGIFEAIAGLLENIFK

SEQ ID NO: 744 - protein, 16 aa, Artificial Sequence
  Description of Artificial Sequence: Synthetic peptide
CGIFEAIAGLLWNIFK

SEQ ID NO: 745 - protein, 16 aa, Artificial Sequence
  Description of Artificial Sequence: Synthetic peptide
CGIFEAIAGLLKEIFK

SEQ ID NO: 746 - protein, 16 aa, Artificial Sequence
  Description of Artificial Sequence: Synthetic peptide
CGIFEAIAGLLKNILK

SEQ ID NO: 747 - protein, 16 aa, Artificial Sequence
  Description of Artificial Sequence: Synthetic peptide
CGIFEAIAGLLRNIFK

SEQ ID NO: 748 - protein, 16 aa, Artificial Sequence
  Description of Artificial Sequence: Synthetic peptide
CGIFEAIAGLLKSIFK

SEQ ID NO: 749 - protein, 16 aa, Artificial Sequence
  Description of Artificial Sequence: Synthetic peptide
CGIFEAIAGLLKNILK

SEQ ID NO: 750 - protein, 16 aa, Artificial Sequence
  Description of Artificial Sequence: Synthetic peptide
CGFFGAIWEFIKSILK

SEQ ID NO: 751 - protein, 16 aa, Artificial Sequence
  Description of Artificial Sequence: Synthetic peptide
CGFFEAIWEFIKSILK

SEQ ID NO: 752 - protein, 16 aa, Artificial Sequence
  Description of Artificial Sequence: Synthetic peptide
CGFFGAIWGLLKSILK

SEQ ID NO: 753 - protein, 16 aa, Artificial Sequence
  Description of Artificial Sequence: Synthetic peptide
CGFFEAIWGLLKSILK

SEQ ID NO: 754 - protein, 16 aa, Artificial Sequence
  Description of Artificial Sequence: Synthetic peptide
CGFFEAIAGLLKSILK

SEQ ID NO: 755 - protein, 16 aa, Artificial Sequence
  Description of Artificial Sequence: Synthetic peptide
CGFFGAIAGLLKSILK

SEQ ID NO: 756 - protein, 19 aa, Artificial Sequence
  Description of Artificial Sequence: Synthetic peptide
CGIFEAIAGLLKNIFEGLI

SEQ ID NO: 757 - protein, 19 aa, Artificial Sequence
  Description of Artificial Sequence: Synthetic peptide
CGIFEAIWGLLKNIFKGLI

SEQ ID NO: 758 - protein, 19 aa, Artificial Sequence
  Description of Artificial Sequence: Synthetic peptide
CGIFEAIWGLLKNIFEGLI

SEQ ID NO: 759 - protein, 24 aa, Artificial Sequence
  Description of Artificial Sequence: Synthetic peptide
CGIFEAIAGLLKNILKGLIDGWYG

SEQ ID NO: 760 - protein, 24 aa, Artificial Sequence
  Description of Artificial Sequence: Synthetic peptide
CGIFGAIAGLLKNILKGLIDGWYG

SEQ ID NO: 761 - protein, 24 aa, Artificial Sequence
  Description of Artificial Sequence: Synthetic peptide
CGIFGAIAGLLKNIFKGLIDGWYG

SEQ ID NO: 762 - protein, 16 aa, Artificial Sequence
  Description of Artificial Sequence: Synthetic peptide
CGIFGAIWELWEWILK

SEQ ID NO: 763 - protein, 16 aa, Artificial Sequence
  Description of Artificial Sequence: Synthetic peptide
CGIFEAIWELWEWILK

SEQ ID NO: 764 - protein, 15 aa, Artificial Sequence
  Description of Artificial Sequence: Synthetic peptide
CIFGAIWELWEWILK

SEQ ID NO: 765 - protein, 15 aa, Artificial Sequence
  Description of Artificial Sequence: Synthetic peptide
CIFEAIWELWEWILK

SEQ ID NO: 766 - protein, 16 aa, Artificial Sequence
  Description of Artificial Sequence: Synthetic peptide
CGIFEAIAELWKNIFK

SEQ ID NO: 767 - protein, 16 aa, Artificial Sequence
  Description of Artificial Sequence: Synthetic peptide
CGIFEAIAELWENIFK

SEQ ID NO: 768 - protein, 16 aa, Artificial Sequence
  Description of Artificial Sequence: Synthetic peptide
CGIFEAIAELWKWIFK

SEQ ID NO: 769 - protein, 16 aa, Artificial Sequence
  Description of Artificial Sequence: Synthetic peptide
CGIFEAIAELWEWIFK

SEQ ID NO: 770 - protein, 24 aa, Artificial Sequence
  Description of Artificial Sequence: Synthetic peptide
CGIFEAIAGLLKNILKGLIDWWYG

SEQ ID NO: 771 - protein, 24 aa, Artificial Sequence
  Description of Artificial Sequence: Synthetic peptide
CGIFGAIAGLLKNILKGLIDWWYG

SEQ ID NO: 772 - protein, 24 aa, Artificial Sequence
  Description of Artificial Sequence: Synthetic peptide
CGIFGAIAGLLKNIFKGLIDWWYG

SEQ ID NO: 773 - protein, 25 aa, Artificial Sequence
  Description of Artificial Sequence: Synthetic peptide
CGIFEAIAGLLKNILKGLIDGWYGF

SEQ ID NO: 774 - protein, 25 aa, Artificial Sequence
  Description of Artificial Sequence: Synthetic peptide
CGIFGAIAGLLKNILKGLIDGWYGF

SEQ ID NO: 775 - protein, 25 aa, Artificial Sequence
  Description of Artificial Sequence: Synthetic peptide
CGIFGAIAGLLKNIFKGLIDGWYGF

SEQ ID NO: 776 - protein, 16 aa, Artificial Sequence
  Description of Artificial Sequence: Synthetic peptide
CGIFGAIAELLEKIFE

SEQ ID NO: 777 - protein, 16 aa, Artificial Sequence
  Description of Artificial Sequence: Synthetic peptide
CGIFEAIAELLEKIFE

SEQ ID NO: 778 - protein, 16 aa, Artificial Sequence
  Description of Artificial Sequence: Synthetic peptide
CGFIGAIAELLEKIFE

SEQ ID NO: 779 - protein, 16 aa, Artificial Sequence
  Description of Artificial Sequence: Synthetic peptide
CGIFGAIAELLEKIFK

SEQ ID NO: 780 - protein, 16 aa, Artificial Sequence
  Description of Artificial Sequence: Synthetic peptide
CGIFEAIAELLEKIFK

SEQ ID NO: 781 - protein, 16 aa, Artificial Sequence
  Description of Artificial Sequence: Synthetic peptide
CGFIGAIAELLEKIFK

SEQ ID NO: 782 - protein, 21 aa, Artificial Sequence
  Description of Artificial Sequence: Synthetic peptide
CGLFHALLHLLHSLWHLLLEA

SEQ ID NO: 783 - protein, 21 aa, Artificial Sequence
  Description of Artificial Sequence: Synthetic peptide
GLFHALLHLLHSLWHGLLEAC

SEQ ID NO: 784 - protein, 21 aa, Artificial Sequence
  Description of Artificial Sequence: Synthetic peptide
GFFHAFFHFFHSFWHGFFEAC

SEQ ID NO: 785 - protein, 21 aa, Artificial Sequence
  Description of Artificial Sequence: Synthetic peptide
GLFHALLHLLHSLWHLLLEAC

SEQ ID NO: 786 - protein, 22 aa, Artificial Sequence
  Description of Artificial Sequence: Synthetic peptide
CGLFHALLHLLHSLWHGLLEAK

SEQ ID NO: 787 - protein, 22 aa, Artificial Sequence
  Description of Artificial Sequence: Synthetic peptide
CGFFHAFFHFFHSFWHGFFEAK

SEQ ID NO: 788 - protein, 22 aa, Artificial Sequence
  Description of Artificial Sequence: Synthetic peptide
CGLFHALLHLLHSLWHLLLEAK

SEQ ID NO: 789 - protein, 21 aa, Artificial Sequence
  Description of Artificial Sequence: Synthetic peptide
GLFHALLHLLHSLWHGLLEAC

SEQ ID NO: 790 - protein, 21 aa, Artificial Sequence
  Description of Artificial Sequence: Synthetic peptide
GFFHAFFHFFHSFWHGFFEAC

SEQ ID NO: 791 - protein, 21 aa, Artificial Sequence
  Description of Artificial Sequence: Synthetic peptide
GLFHALLHLLHSLWHLLLEAC

SEQ ID NO: 792 - protein, 21 aa, Artificial Sequence
  Description of Artificial Sequence: Synthetic peptide
CGFFHAFFHFFHSFWHFFFEA

SEQ ID NO: 793 - protein, 21 aa, Artificial Sequence
  Description of Artificial Sequence: Synthetic peptide
CGFFHAFFHFFHSFWHLFFEA

SEQ ID NO: 794 - protein, 21 aa, Artificial Sequence
  Description of Artificial Sequence: Synthetic peptide
CGLFHALLHLLHSLWHGLLEW

SEQ ID NO: 795 - protein, 21 aa, Artificial Sequence
  Description of Artificial Sequence: Synthetic peptide
CGLFHALLHLLHSLWHLLLEW

SEQ ID NO: 796 - protein, 21 aa, Artificial Sequence
  Description of Artificial Sequence: Synthetic peptide
CGFFHAFFHFFHSFWHGFFEW

SEQ ID NO: 797 - protein, 14 aa, Artificial Sequence
  Description of Artificial Sequence: Synthetic peptide
CFFGAIWEFAKSIL

SEQ ID NO: 798 - protein, 14 aa, Artificial Sequence
  Description of Artificial Sequence: Synthetic peptide
CFFGAIWEFAHSIL

SEQ ID NO: 799 - protein, 14 aa, Artificial Sequence
  Description of Artificial Sequence: Synthetic peptide
CFFGAIWEFAHGIL

SEQ ID NO: 800 - protein, 15 aa, Artificial Sequence
  Description of Artificial Sequence: Synthetic peptide
CFFGAIWEFIHSILK

SEQ ID NO: 801 - protein, 15 aa, Artificial Sequence
  Description of Artificial Sequence: Synthetic peptide
CFFGAIWEFIHSILH

SEQ ID NO: 802 - protein, 15 aa, Artificial Sequence
  Description of Artificial Sequence: Synthetic peptide
CFFGAIWEFIHSILD

SEQ ID NO: 803 - protein, 15 aa, Artificial Sequence
  Description of Artificial Sequence: Synthetic peptide
CFFGAIWEFIHSILR

SEQ ID NO: 804 - protein, 15 aa, Artificial Sequence
  Description of Artificial Sequence: Synthetic peptide
  MOD_RES (15)..(15): Ornithine
CFFGAIWEFIHSILX

SEQ ID NO: 805 - protein, 14 aa, Artificial Sequence
  Description of Artificial Sequence: Synthetic peptide
CFFGAIAEFIHSIL

SEQ ID NO: 806 - protein, 14 aa, Artificial Sequence
  Description of Artificial Sequence: Synthetic peptide
CIFGAIWEFIHSIL

SEQ ID NO: 807 - protein, 15 aa, Artificial Sequence
  Description of Artificial Sequence: Synthetic peptide
CGIFGAIWEFIHSIL

SEQ ID NO: 808 - protein, 15 aa, Artificial Sequence
  Description of Artificial Sequence: Synthetic peptide
CFFGAIWEFIHSILE

SEQ ID NO: 809 - protein, 16 aa, Artificial Sequence
  Description of Artificial Sequence: Synthetic peptide
CFFGAIWEFIHSILEG

SEQ ID NO: 810 - protein, 17 aa, Artificial Sequence
  Description of Artificial Sequence: Synthetic peptide
CFFGAIWEFIHSILEGL

SEQ ID NO: 811 - protein, 18 aa, Artificial Sequence
  Description of Artificial Sequence: Synthetic peptide
CFFGAIWEFIHSILEGLI

SEQ ID NO: 812 - protein, 19 aa, Artificial Sequence
  Description of Artificial Sequence: Synthetic peptide
CFFGAIWEFIHSILEGLID

SEQ ID NO: 813 - protein, 20 aa, Artificial Sequence
  Description of Artificial Sequence: Synthetic peptide
CFFGAIWEFIHSILEGLIDG

SEQ ID NO: 814 - protein, 20 aa, Artificial Sequence
  Description of Artificial Sequence: Synthetic peptide
CFFGAIWEFIHSILEGLIEA

SEQ ID NO: 815 - protein, 20 aa, Artificial Sequence
  Description of Artificial Sequence: Synthetic peptide
CFFGAIWEFIHSILEGLIDW

SEQ ID NO: 816 - protein, 23 aa, Artificial Sequence
  Description of Artificial Sequence: Synthetic peptide
CFFGAIWEFIHSILEGLIDGWYG

SEQ ID NO: 817 - protein, 24 aa, Artificial Sequence
  Description of Artificial Sequence: Synthetic peptide
CFFGAIWEFIHSILEGLIDGWYGF

SEQ ID NO: 818 - protein, 14 aa, Artificial Sequence
  Description of Artificial Sequence: Synthetic peptide
FFGAIWEFIHSILC

SEQ ID NO: 819 - protein, 14 aa, Artificial Sequence
  Description of Artificial Sequence: Synthetic peptide
CFWGAIWEFIHSIL

SEQ ID NO: 820 - protein, 20 aa, Artificial Sequence
  Description of Artificial Sequence: Synthetic peptide
CFFGAIWEFIHSILKGLIDW

SEQ ID NO: 821 - protein, 14 aa, Artificial Sequence
  Description of Artificial Sequence: Synthetic peptide
CAFGKIWEFAHSIL

SEQ ID NO: 822 - protein, 14 aa, Artificial Sequence
  Description of Artificial Sequence: Synthetic peptide
CAFGKIWEFIHSIL

SEQ ID NO: 823 - protein, 14 aa, Artificial Sequence
  Description of Artificial Sequence: Synthetic peptide
CFFGKIWEFIHSIL

SEQ ID NO: 824 - protein, 14 aa, Artificial Sequence
  Description of Artificial Sequence: Synthetic peptide
CAFGAIWEFIHSIL

SEQ ID NO: 825 - protein, 14 aa, Artificial Sequence
  Description of Artificial Sequence: Synthetic peptide
CAFGAIWEFAHSIL

SEQ ID NO: 826 - protein, 16 aa, Artificial Sequence
  Description of Artificial Sequence: Synthetic peptide
CGFFGAIAGLLHNIFK

SEQ ID NO: 827 - protein, 15 aa, Artificial Sequence
  Description of Artificial Sequence: Synthetic peptide
CFFGAIAGLLHNIFK

SEQ ID NO: 828 - protein, 16 aa, Artificial Sequence
  Description of Artificial Sequence: Synthetic peptide
CGFFEAIEGLLHNIFK

SEQ ID NO: 829 - protein, 15 aa, Artificial Sequence
  Description of Artificial Sequence: Synthetic peptide
CFFEAIAGLLHNIFK

SEQ ID NO: 830 - protein, 15 aa, Artificial Sequence
  Description of Artificial Sequence: Synthetic peptide
CFFEAIWGLLHNIFK

SEQ ID NO: 831 - protein, 16 aa, Artificial Sequence
  Description of Artificial Sequence: Synthetic peptide
CGFFGAIAELLHNIFK

SEQ ID NO: 832 - protein, 15 aa, Artificial Sequence
  Description of Artificial Sequence: Synthetic peptide
CFFGAIAELLHNIFK

SEQ ID NO: 833 - protein, 16 aa, Artificial Sequence
  Description of Artificial Sequence: Synthetic peptide
CGFFEAIAELLHNIFK

SEQ ID NO: 834 - protein, 15 aa, Artificial Sequence
  Description of Artificial Sequence: Synthetic peptide
CFFEAIAELLHNIFK

SEQ ID NO: 835 - protein, 15 aa, Artificial Sequence
  Description of Artificial Sequence: Synthetic peptide
CFFGAIWELLHNIFK

SEQ ID NO: 836 - protein, 15 aa, Artificial Sequence
  Description of Artificial Sequence: Synthetic peptide
CFFEAIWELLHNIFK

SEQ ID NO: 837 - protein, 27 aa, Artificial Sequence
  Description of Artificial Sequence: Synthetic peptide
CFFGAIWEFIHSILFFGAIWEFIHSIL

SEQ ID NO: 838 - protein, 30 aa, Artificial Sequence
  Description of Artificial Sequence: Synthetic polypeptide
CFFGAIWEFIHSILGGGFFGAIWEFIHSIL

SEQ ID NO: 839 - protein, 28 aa, Artificial Sequence
  Description of Artificial Sequence: Synthetic peptide
CFFGAIWEFIHSILGFFGAIWEFIHSIL

SEQ ID NO: 840 - protein, 21 aa, Artificial Sequence
  Description of Artificial Sequence: Synthetic peptide
GGLFEALLELLESLWELLLEW

SEQ ID NO: 841 - protein, 21 aa, Artificial Sequence
  Description of Artificial Sequence: Synthetic peptide
GGFFEAFFEFFESFWEFFFEA

SEQ ID NO: 842 - protein, 21 aa, Artificial Sequence
  Description of Artificial Sequence: Synthetic peptide
GGLFEALLELLESLWEGLLEA

SEQ ID NO: 843 - protein, 21 aa, Artificial Sequence
  Description of Artificial Sequence: Synthetic peptide
CGLFHALLHLLHSLWHLLLHA

SEQ ID NO: 844 - protein, 21 aa, Artificial Sequence
  Description of Artificial Sequence: Synthetic peptide
CGLFEALLHLLHSLWHLLLEA

SEQ ID NO: 845 - protein, 21 aa, Artificial Sequence
  Description of Artificial Sequence: Synthetic peptide
CGLFEALLELLHSLWHLLLEA

SEQ ID NO: 846 - protein, 21 aa, Artificial Sequence
  Description of Artificial Sequence: Synthetic peptide
CGLFEALLHLLESLWHLLLEA

SEQ ID NO: 847 - protein, 21 aa, Artificial Sequence
  Description of Artificial Sequence: Synthetic peptide
CGLFEALLHLLHSLWELLLEA

SEQ ID NO: 848 - protein, 21 aa, Artificial Sequence
  Description of Artificial Sequence: Synthetic peptide
CGLFHALLELLHSLWHLLLEA

SEQ ID NO: 849 - protein, 21 aa, Artificial Sequence
  Description of Artificial Sequence: Synthetic peptide
CGLFHALLHLLESLWHLLLEA

SEQ ID NO: 850 - protein, 21 aa, Artificial Sequence
  Description of Artificial Sequence: Synthetic peptide
CGLFHALLHLLHSLWELLLEA

SEQ ID NO: 851 - protein, 21 aa, Artificial Sequence
  Description of Artificial Sequence: Synthetic peptide
CGLFHALLELLESLWHLLLEA

SEQ ID NO: 852 - protein, 21 aa, Artificial Sequence
  Description of Artificial Sequence: Synthetic peptide
CGLFHALLELLHSLWELLLEA

SEQ ID NO: 853 - protein, 21 aa, Artificial Sequence
  Description of Artificial Sequence: Synthetic peptide
CGLFHALLHLLESLWELLLEA

SEQ ID NO: 854 - protein, 21 aa, Artificial Sequence
  Description of Artificial Sequence: Synthetic peptide
CGLFEALLHLLESLWELLLEA

SEQ ID NO: 855 - protein, 21 aa, Artificial Sequence
  Description of Artificial Sequence: Synthetic peptide
CGLFEALLELLHSLWELLLEA

SEQ ID NO: 856 - protein, 20 aa, Artificial Sequence
  Description of Artificial Sequence: Synthetic peptide
CGLEALLELLESLWHLLLEA

SEQ ID NO: 857 - protein, 21 aa, Artificial Sequence
  Description of Artificial Sequence: Synthetic peptide
CGLFHALLELLESLWELLLEA

SEQ ID NO: 858 - protein, 20 aa, Artificial Sequence
  Description of Artificial Sequence: Synthetic peptide
CFFGAIWEFIHSILHLLLEA

SEQ ID NO: 859 - protein, 20 aa, Artificial Sequence
  Description of Artificial Sequence: Synthetic peptide
CFFGAIWEFIHSILKLLLEA

SEQ ID NO: 860 - protein, 29 aa, Artificial Sequence
  Description of Artificial Sequence: Synthetic peptide
CGFFGAIWEFIHSILGFFGAIWEFIHSIL

SEQ ID NO: 861 - protein, 27 aa, Artificial Sequence
  Description of Artificial Sequence: Synthetic peptide
CFFGAIWEFAHSILFFGAIWEFAHSIL

SEQ ID NO: 862 - protein, 28 aa, Artificial Sequence
  Description of Artificial Sequence: Synthetic peptide
CFFGAIWEFAHSILGFFGAIWEFAHSIL

SEQ ID NO: 863 - protein, 29 aa, Artificial Sequence
  Description of Artificial Sequence: Synthetic peptide
CGFFGAIWEFAHSILGFFGAIWEFAHSIL

SEQ ID NO: 864 - protein, 34 aa, Artificial Sequence
  Description of Artificial Sequence: Synthetic polypeptide
CFFGAIWEFIHSILGLFEAIEGFIENGWEGMIDG

SEQ ID NO: 865 - protein, 37 aa, Artificial Sequence
  Description of Artificial Sequence: Synthetic polypeptide
CFFGAIWEFIHSILGLFEAIEGFIENGWEGMIDGWYG

SEQ ID NO: 866 - protein, 38 aa, Artificial Sequence
  Description of Artificial Sequence: Synthetic polypeptide
CFFGAIWEFIHSILGLFEAIEGFIENGWEGMIDGWYGF

SEQ ID NO: 867 - protein, 20 aa, Artificial Sequence
  Description of Artificial Sequence: Synthetic peptide
CFFGALLEFIHSILELLLEA

SEQ ID NO: 868 - protein, 21 aa, Artificial Sequence
  Description of Artificial Sequence: Synthetic peptide
CGLFGALLEFIHSILELLLEA

SEQ ID NO: 869 - protein, 21 aa, Artificial Sequence
  Description of Artificial Sequence: Synthetic peptide
CGFFGALLEFIHSILELLLEA

SEQ ID NO: 870 - protein, 20 aa, Artificial Sequence
  Description of Artificial Sequence: Synthetic peptide
CFFGALLEFIHSLWELLLEA

SEQ ID NO: 871 - protein, 21 aa, Artificial Sequence
  Description of Artificial Sequence: Synthetic peptide
CGLFGALLEFIHSLWELLLEA

SEQ ID NO: 872 - protein, 21 aa, Artificial Sequence
  Description of Artificial Sequence: Synthetic peptide
CGFFGALLEFIHSLWELLLEA

SEQ ID NO: 873 - protein, 15 aa, Artificial Sequence
  Description of Artificial Sequence: Synthetic peptide
CIFGAIAGFIKNIWK

SEQ ID NO: 874 - protein, 14 aa, Artificial Sequence
  Description of Artificial Sequence: Synthetic peptide
IFGAIAGFIKNIWC

SEQ ID NO: 875 - protein, 15 aa, Artificial Sequence
  Description of Artificial Sequence: Synthetic peptide
CFFGAIWEFIKSILK

SEQ ID NO: 876 - protein, 14 aa, Artificial Sequence
  Description of Artificial Sequence: Synthetic peptide
FFGAIWEFIKSILC

SEQ ID NO: 877 - protein, 15 aa, Artificial Sequence
  Description of Artificial Sequence: Synthetic peptide
CFFGAIWEFIHSILK

SEQ ID NO: 878 - protein, 14 aa, Artificial Sequence
  Description of Artificial Sequence: Synthetic peptide
FFGAIWEFIHSILC

SEQ ID NO: 879 - protein, 19 aa, Artificial Sequence
  Description of Artificial Sequence: Synthetic peptide
CIFGAIAGFIKNIWEGLIK

SEQ ID NO: 880 - protein, 18 aa, Artificial Sequence
  Description of Artificial Sequence: Synthetic peptide
IFGAIAGFIKNIWEGLIC

SEQ ID NO: 881 - protein, 17 aa, Artificial Sequence
  Description of Artificial Sequence: Synthetic peptide
IFGAIAGFIKNILKGLC

SEQ ID NO: 882 - protein, 18 aa, Artificial Sequence
  Description of Artificial Sequence: Synthetic peptide
GIFGAIAGFIKNILKGLC

SEQ ID NO: 883 - protein, 18 aa, Artificial Sequence
  Description of Artificial Sequence: Synthetic peptide
CIFGAIAGFIKNILKGLK

SEQ ID NO: 884 - protein, 21 aa, Artificial Sequence
  Description of Artificial Sequence: Synthetic peptide
CGLFGAIAGFIVNGWVGMIDG

SEQ ID NO: 885 - protein, 24 aa, Artificial Sequence
  Description of Artificial Sequence: Synthetic peptide
CGLFGAIAGFIVNGWVGMIDGWYG

SEQ ID NO: 886 - protein, 24 aa, Artificial Sequence
  Description of Artificial Sequence: Synthetic peptide
CGLFEAIEGFIVNGWVGMIDGWYG

SEQ ID NO: 887 - protein, 25 aa, Artificial Sequence
  Description of Artificial Sequence: Synthetic peptide
CGLFGAIAGFIVNGWVGMIDGWYGF

SEQ ID NO: 888 - protein, 26 aa, Artificial Sequence
  Description of Artificial Sequence: Synthetic peptide
CGLFEAIEAGFIVNGWVGMIDGWYGF

SEQ ID NO: 889 - protein, 25 aa, Artificial Sequence
  Description of Artificial Sequence: Synthetic peptide
CGLFGAIAGFIVNGWVGMIDGWYGK

SEQ ID NO: 890 - protein, 25 aa, Artificial Sequence
  Description of Artificial Sequence: Synthetic peptide
CGLFEAIEGFIVNGWVGMIDGWYGK

SEQ ID NO: 891 - protein, 24 aa, Artificial Sequence
  Description of Artificial Sequence: Synthetic peptide
GLFGAIAGFIVNGWVGMIDGWYGC

SEQ ID NO: 892 - protein, 24 aa, Artificial Sequence
  Description of Artificial Sequence: Synthetic peptide
GLFEAIEGFIVNGWVGMIDGWYGC

SEQ ID NO: 893 - protein, 25 aa, Artificial Sequence
  Description of Artificial Sequence: Synthetic peptide
GLFGAIAGFIVNGWVGMIDGWYGFC

SEQ ID NO: 894 - protein, 26 aa, Artificial Sequence
  Description of Artificial Sequence: Synthetic peptide
GLFEAIEAGFIVNGWVGMIDGWYGFC

SEQ ID NO: 895 - protein, 15 aa, Artificial Sequence
  Description of Artificial Sequence: Synthetic peptide
CFFGAIWGLLHSILH

SEQ ID NO: 896 - protein, 14 aa, Artificial Sequence
  Description of Artificial Sequence: Synthetic peptide
CFFGAIWELLHSIL

SEQ ID NO: 897 - protein, 15 aa, Artificial Sequence
  Description of Artificial Sequence: Synthetic peptide
CFFGAIWELLHSILH

SEQ ID NO: 898 - protein, 15 aa, Artificial Sequence
  Description of Artificial Sequence: Synthetic peptide
CFFGAIWGLLHSILK

SEQ ID NO: 899 - protein, 15 aa, Artificial Sequence
  Description of Artificial Sequence: Synthetic peptide
CFFGAIWELLHSILK

SEQ ID NO: 900 - protein, 21 aa, Artificial Sequence
  Description of Artificial Sequence: Synthetic peptide
CGLFGALLHLLHSLWELLLEA

SEQ ID NO: 901 - protein, 21 aa, Artificial Sequence
  Description of Artificial Sequence: Synthetic peptide
CGLFGALLELLHSLWELLLEA

SEQ ID NO: 902 - protein, 20 aa, Artificial Sequence
  Description of Artificial Sequence: Synthetic peptide
CFFGAIWEFIHSILELLLEA

SEQ ID NO: 903 - protein, 20 aa, Artificial Sequence
  Description of Artificial Sequence: Synthetic peptide
CFFGAIWEFIHSILHGLLEA

SEQ ID NO: 904 - protein, 20 aa, Artificial Sequence
  Description of Artificial Sequence: Synthetic peptide
CFFGAIWEFIHSILEGLLEA

SEQ ID NO: 905 - protein, 21 aa, Artificial Sequence
  Description of Artificial Sequence: Synthetic peptide
CGFFGAIWEFIHSILHLLLEA

SEQ ID NO: 906 - protein, 21 aa, Artificial Sequence
  Description of Artificial Sequence: Synthetic peptide
CGFFGAIWEFIHSILELLLEA

SEQ ID NO: 907 - protein, 21 aa, Artificial Sequence
  Description of Artificial Sequence: Synthetic peptide
CGFFGAIWEFIHSILHGLLEA

SEQ ID NO: 908 - protein, 21 aa, Artificial Sequence
  Description of Artificial Sequence: Synthetic peptide
CGFFGAIWEFIHSILEGLLEA

SEQ ID NO: 909 - protein, 15 aa, Artificial Sequence
  Description of Artificial Sequence: Synthetic peptide
CGFFGAIAGLLHSIL

SEQ ID NO: 910 - protein, 15 aa, Artificial Sequence
  Description of Artificial Sequence: Synthetic peptide
CGFFGAIWGLLHSIL

SEQ ID NO: 911 - protein, 15 aa, Artificial Sequence
  Description of Artificial Sequence: Synthetic peptide
CGFFGALLGLLHSIL

SEQ ID NO: 912 - protein, 14 aa, Artificial Sequence
  Description of Artificial Sequence: Synthetic peptide
CFFGAIWEFAKSAL

SEQ ID NO: 913 - protein, 17 aa, Artificial Sequence
  Description of Artificial Sequence: Synthetic peptide
CIFGAIAGFIHNILKGL

SEQ ID NO: 914 - protein, 17 aa, Artificial Sequence
  Description of Artificial Sequence: Synthetic peptide
CFFGAIAGFIKNILKGL

SEQ ID NO: 915 - protein, 17 aa, Artificial Sequence
  Description of Artificial Sequence: Synthetic peptide
CIFGAIWGFIKNILKGL

SEQ ID NO: 916 - protein, 17 aa, Artificial Sequence
  Description of Artificial Sequence: Synthetic peptide
CIFGAIWGFIHNILKGL

SEQ ID NO: 917 - protein, 17 aa, Artificial Sequence
  Description of Artificial Sequence: Synthetic peptide
CIFGAIAGLLKNILKGL

SEQ ID NO: 918 - protein, 17 aa, Artificial Sequence
  Description of Artificial Sequence: Synthetic peptide
CIFGAIAGLLHNILKGL

SEQ ID NO: 919 - protein, 17 aa, Artificial Sequence
  Description of Artificial Sequence: Synthetic peptide
CIFEAIAGFIKNILKGL

SEQ ID NO: 920 - protein, 17 aa, Artificial Sequence
  Description of Artificial Sequence: Synthetic peptide
CIFEAIAGFIHNILKGL

SEQ ID NO: 921 - protein, 24 aa, Artificial Sequence
  Description of Artificial Sequence: Synthetic peptide
CGNFGEIAELIEEGLKNLIDWWNG

SEQ ID NO: 922 - protein, 24 aa, Artificial Sequence
  Description of Artificial Sequence: Synthetic peptide
CGFFGEIAELIEEGLENLIDWWNG

SEQ ID NO: 923 - protein, 24 aa, Artificial Sequence
  Description of Artificial Sequence: Synthetic peptide
CGNFGEIEELIEEGLKNLIDWWNG

SEQ ID NO: 924 - protein, 24 aa, Artificial Sequence
  Description of Artificial Sequence: Synthetic peptide
CGNFGEIAELIEEGLENLIDWWNG

SEQ ID NO: 925 - protein, 24 aa, Artificial Sequence
  Description of Artificial Sequence: Synthetic peptide
CGFFGEIEELIEENGENLIDWWNG

SEQ ID NO: 926 - protein, 24 aa, Artificial Sequence
  Description of Artificial Sequence: Synthetic peptide
CGFFGAIEELIEEGLKNLIDWWNG

SEQ ID NO: 927 - protein, 24 aa, Artificial Sequence
  Description of Artificial Sequence: Synthetic peptide
CGFFGAIAELIEEGLKNLIDWWNG

SEQ ID NO: 928 - protein, 25 aa, Artificial Sequence
  Description of Artificial Sequence: Synthetic peptide
CGFFGEIAELIEEGLKNLIDWWNGF

SEQ ID NO: 929 - protein, 24 aa, Artificial Sequence
  Description of Artificial Sequence: Synthetic peptide
GFFGEIAELIEEGLKNLIDWWNGC

SEQ ID NO: 930 - protein, 24 aa, Artificial Sequence
  Description of Artificial Sequence: Synthetic peptide
GNWWDILNKLGEEILEAIEGFFGC

SEQ ID NO: 931 - protein, 24 aa, Artificial Sequence
  Description of Artificial Sequence: Synthetic peptide
CGNWWDILNKLGEEILEAIEGFFG

SEQ ID NO: 932 - protein, 24 aa, Artificial Sequence
  Description of Artificial Sequence: Synthetic peptide
CGFLGEIAELIEEGLKNLIDWWNG

SEQ ID NO: 933 - protein, 24 aa, Artificial Sequence
  Description of Artificial Sequence: Synthetic peptide
CGFFGEIWELIEEGLKNLIDWWNG

SEQ ID NO: 934 - protein, 24 aa, Artificial Sequence
  Description of Artificial Sequence: Synthetic peptide
CGFFGEIAELWEEGLKNLIDWWNG

SEQ ID NO: 935 - protein, 24 aa, Artificial Sequence
  Description of Artificial Sequence: Synthetic peptide
CGFFGEIAELIWEGLKNLIDWWNG

SEQ ID NO: 936 - protein, 24 aa, Artificial Sequence
  Description of Artificial Sequence: Synthetic peptide
CGFFGEIAELIEWGLKNLIDWWNG

SEQ ID NO: 937 - protein, 24 aa, Artificial Sequence
  Description of Artificial Sequence: Synthetic peptide
CGFFGEIAELIEEGLRNLIDWWNG

SEQ ID NO: 938 - protein, 24 aa, Artificial Sequence
  Description of Artificial Sequence: Synthetic peptide
CGFFGEIAELIEEGLDNLIDWWNG

SEQ ID NO: 939 - protein, 24 aa, Artificial Sequence
  Description of Artificial Sequence: Synthetic peptide
CGFFGEIAELIEEGLKNLNDWWNG

SEQ ID NO: 940 - protein, 24 aa, Artificial Sequence
  Description of Artificial Sequence: Synthetic peptide
CGFFGEIEELIEEGLKNLIDWWNG

SEQ ID NO: 941 - protein, 24 aa, Artificial Sequence
  Description of Artificial Sequence: Synthetic peptide
CGFLGEIEELIEEGLKNLIDWWNG

SEQ ID NO: 942 - protein, 24 aa, Artificial Sequence
  Description of Artificial Sequence: Synthetic peptide
CGFFGLIEELIEEGLKNLIDWWNG

SEQ ID NO: 943 - protein, 25 aa, Artificial Sequence
  Description of Artificial Sequence: Synthetic peptide
CGFFGEIAELIEEGLKNLIDWWNGK

SEQ ID NO: 944 - protein, 24 aa, Artificial Sequence
  Description of Artificial Sequence: Synthetic peptide
GFFGEIAELIEEGLKNLIDWWNGC

SEQ ID NO: 945 - protein, 15 aa, Artificial Sequence
  Description of Artificial Sequence: Synthetic peptide
CFFGAIWEFAKSILK

SEQ ID NO: 946 - protein, 15 aa, Artificial Sequence
  Description of Artificial Sequence: Synthetic peptide
CGFFGAIWEFAKSIL

SEQ ID NO: 947 - protein, 15 aa, Artificial Sequence
  Description of Artificial Sequence: Synthetic peptide
CFFGKIWEFIKSILK

SEQ ID NO: 948 - protein, 14 aa, Artificial Sequence
  Description of Artificial Sequence: Synthetic peptide
FFGKIWEFIKSILC

SEQ ID NO: 949 - protein, 15 aa, Artificial Sequence
  Description of Artificial Sequence: Synthetic peptide
CFFGAIWEFIKSIAK

SEQ ID NO: 950 - protein, 14 aa, Artificial Sequence
  Description of Artificial Sequence: Synthetic peptide
FFGAIWEFIKSIAC

SEQ ID NO: 951 - protein, 14 aa, Artificial Sequence
  Description of Artificial Sequence: Synthetic peptide
FFGAIWEFAKSILC

SEQ ID NO: 952 - protein, 15 aa, Artificial Sequence
  Description of Artificial Sequence: Synthetic peptide
CFFGGIWEFIKSILK

SEQ ID NO: 953 - protein, 14 aa, Artificial Sequence
  Description of Artificial Sequence: Synthetic peptide
FFGGIWEFIKSILC

SEQ ID NO: 954 - protein, 15 aa, Artificial Sequence
  Description of Artificial Sequence: Synthetic peptide
CFFKAIWEFIKSILK

SEQ ID NO: 955 - protein, 14 aa, Artificial Sequence
  Description of Artificial Sequence: Synthetic peptide
FFKAIWEFIKSILC

SEQ ID NO: 956 - protein, 15 aa, Artificial Sequence
  Description of Artificial Sequence: Synthetic peptide
CFFGAIWEAIKSILK

SEQ ID NO: 957 - protein, 14 aa, Artificial Sequence
  Description of Artificial Sequence: Synthetic peptide
FFGAIWEAIKSILC

SEQ ID NO: 958 - protein, 14 aa, Artificial Sequence
  Description of Artificial Sequence: Synthetic peptide
CFFKAIWEFAKSIL

SEQ ID NO: 959 - protein, 14 aa, Artificial Sequence
  Description of Artificial Sequence: Synthetic peptide
CFFKAIWEFAHSIL

SEQ ID NO: 960 - protein, 15 aa, Artificial Sequence
  Description of Artificial Sequence: Synthetic peptide
CFFKAIWEFAKSILK

SEQ ID NO: 961 - protein, 14 aa, Artificial Sequence
  Description of Artificial Sequence: Synthetic peptide
FFKAIWEFAKSILC

SEQ ID NO: 962 - protein, 15 aa, Artificial Sequence
  Description of Artificial Sequence: Synthetic peptide
CFFKAIWEFAHSILK

SEQ ID NO: 963 - protein, 24 aa, Artificial Sequence
  Description of Artificial Sequence: Synthetic peptide
CGLFGEIAELIEEGLENLIDWWNG

SEQ ID NO: 964 - protein, 24 aa, Artificial Sequence
  Description of Artificial Sequence: Synthetic peptide
CGLFGEIEELIEEGLKNLIDWWNG

SEQ ID NO: 965 - protein, 15 aa, Artificial Sequence
  Description of Artificial Sequence: Synthetic peptide
CFFGAIWEFAKSILK

SEQ ID NO: 966 - protein, 24 aa, Artificial Sequence
  Description of Artificial Sequence: Synthetic peptide
CGLFGEIEELIEEGLKGLIDWWNG

SEQ ID NO: 967 - protein, 24 aa, Artificial Sequence
  Description of Artificial Sequence: Synthetic peptide
CGLFGEIAELIEEGLKNLIDWWNG

SEQ ID NO: 968 - protein, 24 aa, Artificial Sequence
  Description of Artificial Sequence: Synthetic peptide
CGLFGEIAELIEEGLEGLIDWWNG

SEQ ID NO: 969 - protein, 24 aa, Artificial Sequence
  Description of Artificial Sequence: Synthetic peptide
GLFGEIEELIEEGLENLIDWWNGC

SEQ ID NO: 970 - protein, 24 aa, Artificial Sequence
  Description of Artificial Sequence: Synthetic peptide
GLFGEIEELIEEGLENLIDWWNGC

SEQ ID NO: 971 - protein, 25 aa, Artificial Sequence
  Description of Artificial Sequence: Synthetic peptide
CGLFGEIEELIEEGLENLIDWWNGK

SEQ ID NO: 972 - protein, 24 aa, Artificial Sequence
  Description of Artificial Sequence: Synthetic peptide
CGNWWDILNELGEEILEEIEGFLG

SEQ ID NO: 973 - protein, 24 aa, Artificial Sequence
  Description of Artificial Sequence: Synthetic peptide
CALFGEIEELIEEGLENLIDWWNG

SEQ ID NO: 974 - protein, 24 aa, Artificial Sequence
  Description of Artificial Sequence: Synthetic peptide
CELFGEIEELIEEGLENLIDWWNG

SEQ ID NO: 975 - protein, 24 aa, Artificial Sequence
  Description of Artificial Sequence: Synthetic peptide
CSLFGEIEELIEEGLENLIDWWNG

SEQ ID NO: 976 - protein, 24 aa, Artificial Sequence
  Description of Artificial Sequence: Synthetic peptide
CNLFGEIEELIEEGLENLIDWWNG

SEQ ID NO: 977 - protein, 24 aa, Artificial Sequence
  Description of Artificial Sequence: Synthetic peptide
CVLFGEIEELIEEGLENLIDWWNG

SEQ ID NO: 978 - protein, 24 aa, Artificial Sequence
  Description of Artificial Sequence: Synthetic peptide
CGFFGEIEELIEEGLENLIDWWNG

SEQ ID NO: 979 - protein, 24 aa, Artificial Sequence
  Description of Artificial Sequence: Synthetic peptide
CGVFGEIEELIEEGLENLIDWWNG

SEQ ID NO: 980 - protein, 24 aa, Artificial Sequence
  Description of Artificial Sequence: Synthetic peptide
CGIFGEIEELIEEGLENLIDWWNG

SEQ ID NO: 981 - protein, 24 aa, Artificial Sequence
  Description of Artificial Sequence: Synthetic peptide
CGWFGEIEELIEEGLENLIDWWNG

SEQ ID NO: 982 - protein, 24 aa, Artificial Sequence
  Description of Artificial Sequence: Synthetic peptide
CGYFGEIEELIEEGLENLIDWWNG

SEQ ID NO: 983 - protein, 24 aa, Artificial Sequence
  Description of Artificial Sequence: Synthetic peptide
CGLLGEIEELIEEGLENLIDWWNG

SEQ ID NO: 984 - protein, 24 aa, Artificial Sequence
  Description of Artificial Sequence: Synthetic peptide
CGLVGEIEELIEEGLENLIDWWNG

SEQ ID NO: 985 - protein, 24 aa, Artificial Sequence
  Description of Artificial Sequence: Synthetic peptide
CGLIGEIEELIEEGLENLIDWWNG

SEQ ID NO: 986 - protein, 24 aa, Artificial Sequence
  Description of Artificial Sequence: Synthetic peptide
CGLWGEIEELIEEGLENLIDWWNG

SEQ ID NO: 987 - protein, 24 aa, Artificial Sequence
  Description of Artificial Sequence: Synthetic peptide
CGLYGEIEELIEEGLENLIDWWNG

SEQ ID NO: 988 - protein, 24 aa, Artificial Sequence
  Description of Artificial Sequence: Synthetic peptide
CGLFEEIEELIEEGLENLIDWWNG

SEQ ID NO: 989 - protein, 24 aa, Artificial Sequence
  Description of Artificial Sequence: Synthetic peptide
CGLFAEIEELIEEGLENLIDWWNG

SEQ ID NO: 990 - protein, 24 aa, Artificial Sequence
  Description of Artificial Sequence: Synthetic peptide
CGLFNEIEELIEEGLENLIDWWNG

SEQ ID NO: 991 - protein, 24 aa, Artificial Sequence
  Description of Artificial Sequence: Synthetic peptide
CGLFSEIEELIEEGLENLIDWWNG

SEQ ID NO: 992 - protein, 24 aa, Artificial Sequence
  Description of Artificial Sequence: Synthetic peptide
CGLFGAIEELIEEGLENLIDWWNG

SEQ ID NO: 993 - protein, 24 aa, Artificial Sequence
  Description of Artificial Sequence: Synthetic peptide
CGLFGDIEELIEEGLENLIDWWNG

SEQ ID NO: 994 - protein, 24 aa, Artificial Sequence
  Description of Artificial Sequence: Synthetic peptide
CGLFGNIEELIEEGLENLIDWWNG

SEQ ID NO: 995 - protein, 24 aa, Artificial Sequence
  Description of Artificial Sequence: Synthetic peptide
CGLFGSIEELIEEGLENLIDWWNG

SEQ ID NO: 996 - protein, 24 aa, Artificial Sequence
  Description of Artificial Sequence: Synthetic peptide
CGLFGELEELIEEGLENLIDWWNG

SEQ ID NO: 997 - protein, 24 aa, Artificial Sequence
  Description of Artificial Sequence: Synthetic peptide
CGLFGEVEELIEEGLENLIDWWNG

SEQ ID NO: 998 - protein, 24 aa, Artificial Sequence
  Description of Artificial Sequence: Synthetic peptide
CGLFGEFEELIEEGLENLIDWWNG

SEQ ID NO: 999 - protein, 24 aa, Artificial Sequence
  Description of Artificial Sequence: Synthetic peptide
CGLFGEWEELIEEGLENLIDWWNG

SEQ ID NO: 1000 - protein, 24 aa, Artificial Sequence
  Description of Artificial Sequence: Synthetic peptide
CGLFGEYEELIEEGLENLIDWWNG

SEQ ID NO: 1001 - protein, 24 aa, Artificial Sequence
  Description of Artificial Sequence: Synthetic peptide
CGLFGEIAELIEEGLENLIDWWNG

SEQ ID NO: 1002 - protein, 24 aa, Artificial Sequence
  Description of Artificial Sequence: Synthetic peptide
CGLFGEIGELIEEGLENLIDWWNG

SEQ ID NO: 1003 - protein, 24 aa, Artificial Sequence
  Description of Artificial Sequence: Synthetic peptide
CGLFGEILELIEEGLENLIDWWNG

SEQ ID NO: 1004 - protein, 24 aa, Artificial Sequence
  Description of Artificial Sequence: Synthetic peptide
CGLFGEIVELIEEGLENLIDWWNG

SEQ ID NO: 1005 - protein, 24 aa, Artificial Sequence
  Description of Artificial Sequence: Synthetic peptide
CGLFGEISELIEEGLENLIDWWNG

SEQ ID NO: 1006 - protein, 24 aa, Artificial Sequence
  Description of Artificial Sequence: Synthetic peptide
CGLFGEIEDLIEEGLENLIDWWNG

SEQ ID NO: 1007 - protein, 24 aa, Artificial Sequence
  Description of Artificial Sequence: Synthetic peptide
CGLFGEIENLIEEGLENLIDWWNG

SEQ ID NO: 1008 - protein, 24 aa, Artificial Sequence
  Description of Artificial Sequence: Synthetic peptide
CGLFGEIESLIEEGLENLIDWWNG

SEQ ID NO: 1009 - protein, 24 aa, Artificial Sequence
  Description of Artificial Sequence: Synthetic peptide
CGLFGEIEALIEEGLENLIDWWNG

SEQ ID NO: 1010 - protein, 24 aa, Artificial Sequence
  Description of Artificial Sequence: Synthetic peptide
CGLFGEIEGLIEEGLENLIDWWNG

SEQ ID NO: 1011 - protein, 24 aa, Artificial Sequence
  Description of Artificial Sequence: Synthetic peptide
CGLFGEIEEVIEEGLENLIDWWNG

SEQ ID NO: 1012 - protein, 24 aa, Artificial Sequence
  Description of Artificial Sequence: Synthetic peptide
CGLFGEIEEIIEEGLENLIDWWNG

SEQ ID NO: 1013 - protein, 24 aa, Artificial Sequence
  Description of Artificial Sequence: Synthetic peptide
CGLFGEIEEFIEEGLENLIDWWNG

SEQ ID NO: 1014 - protein, 24 aa, Artificial Sequence
  Description of Artificial Sequence: Synthetic peptide
CGLFGEIEEAIEEGLENLIDWWNG

SEQ ID NO: 1015 - protein, 24 aa, Artificial Sequence
  Description of Artificial Sequence: Synthetic peptide
CGLFGEIEEYIEEGLENLIDWWNG

SEQ ID NO: 1016 - protein, 24 aa, Artificial Sequence
  Description of Artificial Sequence: Synthetic peptide
CGLFGEIEEWIEEGLENLIDWWNG

SEQ ID NO: 1017 - protein, 24 aa, Artificial Sequence
  Description of Artificial Sequence: Synthetic peptide
CGLFGEIEELVEEGLENLIDWWNG

SEQ ID NO: 1018 - protein, 24 aa, Artificial Sequence
  Description of Artificial Sequence: Synthetic peptide
CGLFGEIEELLEEGLENLIDWWNG

SEQ ID NO: 1019 - protein, 24 aa, Artificial Sequence
  Description of Artificial Sequence: Synthetic peptide
CGLFGEIEELFEEGLENLIDWWNG

SEQ ID NO: 1020 - protein, 24 aa, Artificial Sequence
  Description of Artificial Sequence: Synthetic peptide
CGLFGEIEELAEEGLENLIDWWNG

SEQ ID NO: 1021 - protein, 24 aa, Artificial Sequence
  Description of Artificial Sequence: Synthetic peptide
CGLFGEIEELYEEGLENLIDWWNG

SEQ ID NO: 1022 - protein, 24 aa, Artificial Sequence
  Description of Artificial Sequence: Synthetic peptide
CGLFGEIEELWEEGLENLIDWWNG

SEQ ID NO: 1023 - protein, 24 aa, Artificial Sequence
  Description of Artificial Sequence: Synthetic peptide
CGLFGEIEELIDEGLENLIDWWNG

SEQ ID NO: 1024 - protein, 24 aa, Artificial Sequence
  Description of Artificial Sequence: Synthetic peptide
CGLFGEIEELINEGLENLIDWWNG

SEQ ID NO: 1025 - protein, 24 aa, Artificial Sequence
  Description of Artificial Sequence: Synthetic peptide
CGLFGEIEELISEGLENLIDWWNG

SEQ ID NO: 1026 - protein, 24 aa, Artificial Sequence
  Description of Artificial Sequence: Synthetic peptide
CGLFGEIEELIEDGLENLIDWWNG

SEQ ID NO: 1027 - protein, 24 aa, Artificial Sequence
  Description of Artificial Sequence: Synthetic peptide
CGLFGEIEELIEYGLENLIDWWNG

SEQ ID NO: 1028 - protein, 24 aa, Artificial Sequence
  Description of Artificial Sequence: Synthetic peptide
CGLFGEIEELIESGLENLIDWWNG

SEQ ID NO: 1029 - protein, 24 aa, Artificial Sequence
  Description of Artificial Sequence: Synthetic peptide
CGLFGEIEELIEQGLENLIDWWNG

SEQ ID NO: 1030 - protein, 24 aa, Artificial Sequence
  Description of Artificial Sequence: Synthetic peptide
CGLFGEIEELIENGLENLIDWWNG

SEQ ID NO: 1031 - protein, 24 aa, Artificial Sequence
  Description of Artificial Sequence: Synthetic peptide
CGLFGEIEELIEEALENLIDWWNG

SEQ ID NO: 1032 - protein, 24 aa, Artificial Sequence
  Description of Artificial Sequence: Synthetic peptide
CGLFGEIEELIEENLENLIDWWNG

SEQ ID NO: 1033 - protein, 24 aa, Artificial Sequence
  Description of Artificial Sequence: Synthetic peptide
CGLFGEIEELIEESLENLIDWWNG

SEQ ID NO: 1034 - protein, 24 aa, Artificial Sequence
  Description of Artificial Sequence: Synthetic peptide
CGLFGEIEELIEEQLENLIDWWNG

SEQ ID NO: 1035 - protein, 24 aa, Artificial Sequence
  Description of Artificial Sequence: Synthetic peptide
CGLFGEIEELIEEGWENLIDWWNG

SEQ ID NO: 1036 - protein, 24 aa, Artificial Sequence
  Description of Artificial Sequence: Synthetic peptide
CGLFGEIEELIEEGVENLIDWWNG

SEQ ID NO: 1037 - protein, 24 aa, Artificial Sequence
  Description of Artificial Sequence: Synthetic peptide
CGLFGEIEELIEEGIENLIDWWNG

SEQ ID NO: 1038 - protein, 24 aa, Artificial Sequence
  Description of Artificial Sequence: Synthetic peptide
CGLFGEIEELIEEGFENLIDWWNG

SEQ ID NO: 1039 - protein, 24 aa, Artificial Sequence
  Description of Artificial Sequence: Synthetic peptide
CGLFGEIEELIEEGAENLIDWWNG

SEQ ID NO: 1040 - protein, 24 aa, Artificial Sequence
  Description of Artificial Sequence: Synthetic peptide
CGLFGEIEELIEEGYENLIDWWNG

SEQ ID NO: 1041 - protein, 24 aa, Artificial Sequence
  Description of Artificial Sequence: Synthetic peptide
CGLFGEIEELIEEGLRNLIDWWNG

SEQ ID NO: 1042 - protein, 24 aa, Artificial Sequence
  Description of Artificial Sequence: Synthetic peptide
CGLFGEIEELIEEGLHNLIDWWNG

SEQ ID NO: 1043 - protein, 24 aa, Artificial Sequence
  Description of Artificial Sequence: Synthetic peptide
  MOD_RES (16)..(16): Ornithine
CGLFGEIEELIEEGLXNLIDWWNG

SEQ ID NO: 1044 - protein, 24 aa, Artificial Sequence
  Description of Artificial Sequence: Synthetic peptide
CGLFGEIEELIEEGLDNLIDWWNG

SEQ ID NO: 1045 - protein, 24 aa, Artificial Sequence
  Description of Artificial Sequence: Synthetic peptide
CGLFGEIEELIEEGLKNLIDWWNG

SEQ ID NO: 1046 - protein, 24 aa, Artificial Sequence
  Description of Artificial Sequence: Synthetic peptide
CGLFGEIEELIEEGLEGLIDWWNG

SEQ ID NO: 1047 - protein, 24 aa, Artificial Sequence
  Description of Artificial Sequence: Synthetic peptide
CGLFGEIEELIEEGLEYLIDWWNG

SEQ ID NO: 1048 - protein, 24 aa, Artificial Sequence
  Description of Artificial Sequence: Synthetic peptide
CGLFGEIEELIEEGLEQLIDWWNG

SEQ ID NO: 1049 - protein, 24 aa, Artificial Sequence
  Description of Artificial Sequence: Synthetic peptide
CGLFGEIEELIEEGLESLIDWWNG

SEQ ID NO: 1050 - protein, 24 aa, Artificial Sequence
  Description of Artificial Sequence: Synthetic peptide
CGLFGEIEELIEEGLEALIDWWNG

SEQ ID NO: 1051 - protein, 24 aa, Artificial Sequence
  Description of Artificial Sequence: Synthetic peptide
  MOD_RES (17)..(17): Cit
CGLFGEIEELIEEGLEXLIDWWNG

SEQ ID NO: 1052 - protein, 24 aa, Artificial Sequence
  Description of Artificial Sequence: Synthetic peptide
CGLFGEIEELIEEGLENMIDWWNG

SEQ ID NO: 1053 - protein, 24 aa, Artificial Sequence
  Description of Artificial Sequence: Synthetic peptide
CGLFGEIEELIEEGLENFIDWWNG

SEQ ID NO: 1054 - protein, 24 aa, Artificial Sequence
  Description of Artificial Sequence: Synthetic peptide
CGLFGEIEELIEEGLENIIDWWNG

SEQ ID NO: 1055 - protein, 24 aa, Artificial Sequence
  Description of Artificial Sequence: Synthetic peptide
CGLFGEIEELIEEGLENWIDWWNG

SEQ ID NO: 1056 - protein, 24 aa, Artificial Sequence
  Description of Artificial Sequence: Synthetic peptide
CGLFGEIEELIEEGLENVIDWWNG

SEQ ID NO: 1057 - protein, 24 aa, Artificial Sequence
  Description of Artificial Sequence: Synthetic peptide
CGLFGEIEELIEEGLENYIDWWNG

SEQ ID NO: 1058 - protein, 24 aa, Artificial Sequence
  Description of Artificial Sequence: Synthetic peptide
  MOD_RES (18)..(18): Nle
CGLFGEIEELIEEGLENLIDWWNG

SEQ ID NO: 1059 - protein, 24 aa, Artificial Sequence
  Description of Artificial Sequence: Synthetic peptide
CGLFGEIEELIEEGLENLLDWWNG

SEQ ID NO: 1060 - protein, 24 aa, Artificial Sequence
  Description of Artificial Sequence: Synthetic peptide
CGLFGEIEELIEEGLENLVDWWNG

SEQ ID NO: 1061 - protein, 24 aa, Artificial Sequence
  Description of Artificial Sequence: Synthetic peptide
CGLFGEIEELIEEGLENLFDWWNG

SEQ ID NO: 1062 - protein, 24 aa, Artificial Sequence
  Description of Artificial Sequence: Synthetic peptide
CGLFGEIEELIEEGLENLWDWWNG

SEQ ID NO: 1063 - protein, 24 aa, Artificial Sequence
  Description of Artificial Sequence: Synthetic peptide
CGLFGEIEELIEEGLENLYDWWNG

SEQ ID NO: 1064 - protein, 24 aa, Artificial Sequence
  Description of Artificial Sequence: Synthetic peptide
CGLFGEIEELIEEGLENLIEWWNG

SEQ ID NO: 1065 - protein, 24 aa, Artificial Sequence
  Description of Artificial Sequence: Synthetic peptide
CGLFGEIEELIEEGLENLINWWNG

SEQ ID NO: 1066 - protein, 24 aa, Artificial Sequence
  Description of Artificial Sequence: Synthetic peptide
CGLFGEIEELIEEGLENLISWWNG

SEQ ID NO: 1067 - protein, 24 aa, Artificial Sequence
  Description of Artificial Sequence: Synthetic peptide
CGLFGEIEELIEEGLENLIQWWNG

SEQ ID NO: 1068 - protein, 24 aa, Artificial Sequence
  Description of Artificial Sequence: Synthetic peptide
CGLFGEIEELIEEGLENLIDGWNG

SEQ ID NO: 1069 - protein, 24 aa, Artificial Sequence
  Description of Artificial Sequence: Synthetic peptide
CGLFGEIEELIEEGLENLIDAWNG

SEQ ID NO: 1070 - protein, 24 aa, Artificial Sequence
  Description of Artificial Sequence: Synthetic peptide
CGLFGEIEELIEEGLENLIDFWNG

SEQ ID NO: 1071 - protein, 24 aa, Artificial Sequence
  Description of Artificial Sequence: Synthetic peptide
CGLFGEIEELIEEGLENLIDLWNG

SEQ ID NO: 1072 - protein, 24 aa, Artificial Sequence
  Description of Artificial Sequence: Synthetic peptide
CGLFGEIEELIEEGLENLIDIWNG

SEQ ID NO: 1073 - protein, 24 aa, Artificial Sequence
  Description of Artificial Sequence: Synthetic peptide
CGLFGEIEELIEEGLENLIDVWNG

SEQ ID NO: 1074 - protein, 24 aa, Artificial Sequence
  Description of Artificial Sequence: Synthetic peptide
  MOD_RES (1)..(24): D-amino acid
CGLFGEIEELIEEGLENLIDWGNG

SEQ ID NO: 1075 - protein, 24 aa, Artificial Sequence
  Description of Artificial Sequence: Synthetic peptide
CGLFGEIEELIEEGLENLIDWANG

SEQ ID NO: 1076 - protein, 24 aa, Artificial Sequence
  Description of Artificial Sequence: Synthetic peptide
CGLFGEIEELIEEGLENLIDWFNG

SEQ ID NO: 1077 - protein, 24 aa, Artificial Sequence
  Description of Artificial Sequence: Synthetic peptide
CGLFGEIEELIEEGLENLIDWING

SEQ ID NO: 1078 - protein, 24 aa, Artificial Sequence
  Description of Artificial Sequence: Synthetic peptide
CGLFGEIEELIEEGLENLIDWVNG

SEQ ID NO: 1079 - protein, 24 aa, Artificial Sequence
  Description of Artificial Sequence: Synthetic peptide
CGLFGEIEELIEEGLENLIDWYNG

SEQ ID NO: 1080 - protein, 24 aa, Artificial Sequence
  Description of Artificial Sequence: Synthetic peptide
CGLFGEIEELIEEGLENLIDWWQG

SEQ ID NO: 1081 - protein, 24 aa, Artificial Sequence
  Description of Artificial Sequence: Synthetic peptide
CGLFGEIEELIEEGLENLIDWWTG

SEQ ID NO: 1082 - protein, 24 aa, Artificial Sequence
  Description of Artificial Sequence: Synthetic peptide
CGLFGEIEELIEEGLENLIDWWSG

SEQ ID NO: 1083 - protein, 24 aa, Artificial Sequence
  Description of Artificial Sequence: Synthetic peptide
CGLFGEIEELIEEGLENLIDWWEG

SEQ ID NO: 1084 - protein, 24 aa, Artificial Sequence
  Description of Artificial Sequence: Synthetic peptide
  MOD_RES (23)..(23): Cit
CGLFGEIEELIEEGLENLIDWWXG

SEQ ID NO: 1085 - protein, 24 aa, Artificial Sequence
  Description of Artificial Sequence: Synthetic peptide
CGLFGEIEELIEEGLENLIDWWNA

SEQ ID NO: 1086 - protein, 24 aa, Artificial Sequence
  Description of Artificial Sequence: Synthetic peptide
CGLFGEIEELIEEGLENLIDWWNN

SEQ ID NO: 1087 - protein, 24 aa, Artificial Sequence
  Description of Artificial Sequence: Synthetic peptide
CGLFGEIEELIEEGLENLIDWWNS

SEQ ID NO: 1088 - protein, 24 aa, Artificial Sequence
  Description of Artificial Sequence: Synthetic peptide
CGLFGEIEELIEEGLENLIDWWNY

SEQ ID NO: 1089 - protein, 24 aa, Artificial Sequence
  Description of Artificial Sequence: Synthetic peptide
CGLFGEIEELIEEGLENLIDWWNW

SEQ ID NO: 1090 - protein, 14 aa, Artificial Sequence
  Description of Artificial Sequence: Synthetic peptide
CFFGAIWGLLHSIL

SEQ ID NO: 1091 - protein, 14 aa, Artificial Sequence
  Description of Artificial Sequence: Synthetic peptide
CFFGKIWEFIKSIL

SEQ ID NO: 1092 - protein, 14 aa, Artificial Sequence
  Description of Artificial Sequence: Synthetic peptide
CFFGKIWEFIHSIL

SEQ ID NO: 1093 - protein, 14 aa, Artificial Sequence
  Description of Artificial Sequence: Synthetic peptide
CFFKAIWEFIKSIL

SEQ ID NO: 1094 - protein, 16 aa, Artificial Sequence
  Description of Artificial Sequence: Synthetic peptide
CGFFGAIWGLLHSILK

SEQ ID NO: 1095 - protein, 15 aa, Artificial Sequence
  Description of Artificial Sequence: Synthetic peptide
CGFFEAIWGLLHSIL

SEQ ID NO: 1096 - protein, 14 aa, Artificial Sequence
  Description of Artificial Sequence: Synthetic peptide
CFFGAIWGLLKSIL

SEQ ID NO: 1097 - protein, 15 aa, Artificial Sequence
  Description of Artificial Sequence: Synthetic peptide
CGFFGAIWGLLKSIL

SEQ ID NO: 1098 - protein, 14 aa, Artificial Sequence
  Description of Artificial Sequence: Synthetic peptide
CFFEAIWGLLKSIL

SEQ ID NO: 1099 - protein, 15 aa, Artificial Sequence
  Description of Artificial Sequence: Synthetic peptide
CGFFEAIWGLLKSIL

SEQ ID NO: 1100 - protein, 23 aa, Artificial Sequence
  Description of Artificial Sequence: Synthetic peptide
CFFGAIWGLLHSILKGLIDWWNG

SEQ ID NO: 1101 - protein, 23 aa, Artificial Sequence
  Description of Artificial Sequence: Synthetic peptide
CFFGAIWGLLHSILKGLIDGWYG

SEQ ID NO: 1102 - protein, 17 aa, Artificial Sequence
  Description of Artificial Sequence: Synthetic peptide
CGIFGAIAGLLKNIFKG

SEQ ID NO: 1103 - protein, 17 aa, Artificial Sequence
  Description of Artificial Sequence: Synthetic peptide
CGIFGAIAGLLKNIFKA

SEQ ID NO: 1104 - protein, 17 aa, Artificial Sequence
  Description of Artificial Sequence: Synthetic peptide
CGIFGAIAGLLKNIFKL

SEQ ID NO: 1105 - protein, 17 aa, Artificial Sequence
  Description of Artificial Sequence: Synthetic peptide
CGIFGAIAGLLKNIFKW

SEQ ID NO: 1106 - protein, 17 aa, Artificial Sequence
  Description of Artificial Sequence: Synthetic peptide
CGIFGAIAGLLKNIFKF

SEQ ID NO: 1107 - protein, 17 aa, Artificial Sequence
  Description of Artificial Sequence: Synthetic peptide
CGIFGAIAGLLKNIFKN

SEQ ID NO: 1108 - protein, 17 aa, Artificial Sequence
  Description of Artificial Sequence: Synthetic peptide
CGIFGAIAGLLKNIFKE

SEQ ID NO: 1109 - protein, 17 aa, Artificial Sequence
  Description of Artificial Sequence: Synthetic peptide
CGIFGAIAGLLKNIFKS

SEQ ID NO: 1110 - protein, 16 aa, Artificial Sequence
  Description of Artificial Sequence: Synthetic peptide
CGIFGAIAGLLKNIFK

SEQ ID NO: 1111 - protein, 17 aa, Artificial Sequence
  Description of Artificial Sequence: Synthetic peptide
CGIFGAIAGLLKNIFKK

SEQ ID NO: 1112 - protein, 16 aa, Artificial Sequence
  Description of Artificial Sequence: Synthetic peptide
GIFGAIAGLLKNIFKC

SEQ ID NO: 1113 - protein, 16 aa, Artificial Sequence
  Description of Artificial Sequence: Synthetic peptide
CGIFGAIAGLLKNIFK

SEQ ID NO: 1114 - protein, 17 aa, Artificial Sequence
  Description of Artificial Sequence: Synthetic peptide
CGIFGAIAGLLKNIFKK

SEQ ID NO: 1115 - protein, 16 aa, Artificial Sequence
  Description of Artificial Sequence: Synthetic peptide
GIFGAIAGLLKNIFKC

SEQ ID NO: 1116 - protein, 16 aa, Artificial Sequence
  Description of Artificial Sequence: Synthetic peptide
CGIFGAIAGLLHNIFK

SEQ ID NO: 1117 - protein, 16 aa, Artificial Sequence
  Description of Artificial Sequence: Synthetic peptide
  MOD_RES (12)..(12): Ornithine
CGIFGAIAGLLXNIFK

SEQ ID NO: 1118 - protein, 16 aa, Artificial Sequence
  Description of Artificial Sequence: Synthetic peptide
CGIFGAIAGLLRNIFK

SEQ ID NO: 1119 - protein, 16 aa, Artificial Sequence
  Description of Artificial Sequence: Synthetic peptide
CGIFGAIAGLLENIFK

SEQ ID NO: 1120 - protein, 16 aa, Artificial Sequence
  Description of Artificial Sequence: Synthetic peptide
CGIFGAIAGLLDNIFK

SEQ ID NO: 1121 - protein, 16 aa, Artificial Sequence
  Description of Artificial Sequence: Synthetic peptide
CGIFGAIAGLLKNIFH

SEQ ID NO: 1122 - protein, 16 aa, Artificial Sequence
  Description of Artificial Sequence: Synthetic peptide
  MOD_RES (16)..(16): Ornithine
CGIFGAIAGLLKNIFX

SEQ ID NO: 1123 - protein, 16 aa, Artificial Sequence
  Description of Artificial Sequence: Synthetic peptide
CGIFGAIAGLLKINFE

SEQ ID NO: 1124 - protein, 16 aa, Artificial Sequence
  Description of Artificial Sequence: Synthetic peptide
CGIFGAIAGLLKNIFD

SEQ ID NO: 1125 - protein, 16 aa, Artificial Sequence
  Description of Artificial Sequence: Synthetic peptide
CGIFGAIAGLLKNIFN

SEQ ID NO: 1126 - protein, 16 aa, Artificial Sequence
  Description of Artificial Sequence: Synthetic peptide
CGIFGAIAGLLNNIFK

SEQ ID NO: 1127 - protein, 31 aa, Artificial Sequence
  Description of Artificial Sequence: Synthetic polypeptide
CGIFGIAIGLLKNIFKGIFGAIAGLLKNIFK

SEQ ID NO: 1128 - protein, 17 aa, Artificial Sequence
  Description of Artificial Sequence: Synthetic peptide
CGIFGAIWGLLKNIFKG

SEQ ID NO: 1129 - protein, 17 aa, Artificial Sequence
  Description of Artificial Sequence: Synthetic peptide
CGIFGAIWGLLKNIFKA

SEQ ID NO: 1130 - protein, 17 aa, Artificial Sequence
  Description of Artificial Sequence: Synthetic peptide
CGIFGAIWGLLKNIFKL

SEQ ID NO: 1131 - protein, 17 aa, Artificial Sequence
  Description of Artificial Sequence: Synthetic peptide
CGIFGAIWGLLKNIFKW

SEQ ID NO: 1132 - protein, 17 aa, Artificial Sequence
  Description of Artificial Sequence: Synthetic peptide
CGIFGAIWGLLKNIFKF

SEQ ID NO: 1133 - protein, 17 aa, Artificial Sequence
  Description of Artificial Sequence: Synthetic peptide
CGIFGAIWGLLKNIFKN

SEQ ID NO: 1134 - protein, 17 aa, Artificial Sequence
  Description of Artificial Sequence: Synthetic peptide
CGIFGAIWGLLKNIFKE

SEQ ID NO: 1135 - protein, 17 aa, Artificial Sequence
  Description of Artificial Sequence: Synthetic peptide
CGIFGAIWGLLKNIFKS

SEQ ID NO: 1136 - protein, 16 aa, Artificial Sequence
  Description of Artificial Sequence: Synthetic peptide
CGIFGAIWGLLKNIFK

SEQ ID NO: 1137 - protein, 17 aa, Artificial Sequence
  Description of Artificial Sequence: Synthetic peptide
CGIFGAIWGLLKNIFKK

SEQ ID NO: 1138 - protein, 16 aa, Artificial Sequence
  Description of Artificial Sequence: Synthetic peptide
GIFGAIWGLLKNIFKC

SEQ ID NO: 1139 - protein, 16 aa, Artificial Sequence
  Description of Artificial Sequence: Synthetic peptide
CGIFGAIWGLLKNIFK

SEQ ID NO: 1140 - protein, 17 aa, Artificial Sequence
  Description of Artificial Sequence: Synthetic peptide
CGIFGAIWGLLKNIFKK

SEQ ID NO: 1141 - protein, 16 aa, Artificial Sequence
  Description of Artificial Sequence: Synthetic peptide
GIFGAIWGLLKNIFKC

SEQ ID NO: 1142 - protein, 16 aa, Artificial Sequence
  Description of Artificial Sequence: Synthetic peptide
CGIFGAIWGLLHNIFK

SEQ ID NO: 1143 - protein, 16 aa, Artificial Sequence
  Description of Artificial Sequence: Synthetic peptide
  MOD_RES (12)..(12): Ornithine
CGIFGAIWGLLXNIFK

SEQ ID NO: 1144 - protein, 16 aa, Artificial Sequence
  Description of Artificial Sequence: Synthetic peptide
CGIFGAIWGLLRNIFK

SEQ ID NO: 1145 - protein, 16 aa, Artificial Sequence
  Description of Artificial Sequence: Synthetic peptide
CGIFGAIWGLLENIFK

SEQ ID NO: 1146 - protein, 16 aa, Artificial Sequence
  Description of Artificial Sequence: Synthetic peptide
CGIFGAIWGLLDNIFK

SEQ ID NO: 1147 - protein, 16 aa, Artificial Sequence
  Description of Artificial Sequence: Synthetic peptide
CGIFGAIWGLLKNIFH

SEQ ID NO: 1148 - protein, 16 aa, Artificial Sequence
  Description of Artificial Sequence: Synthetic peptide
  MOD_RES (16)..(16): Ornithine
CGIFGAIWGLLKNIFX

SEQ ID NO: 1149 - protein, 16 aa, Artificial Sequence
  Description of Artificial Sequence: Synthetic peptide
CGIFGAIWGLLKINFE

SEQ ID NO: 1150 - protein, 16 aa, Artificial Sequence
  Description of Artificial Sequence: Synthetic peptide
CGIFGAIWGLLKNIFD

SEQ ID NO: 1151 - protein, 16 aa, Artificial Sequence
  Description of Artificial Sequence: Synthetic peptide
CGIFGAIWGLLKNIFN

SEQ ID NO: 1152 - protein, 16 aa, Artificial Sequence
  Description of Artificial Sequence: Synthetic peptide
CGIFGAIWGLLNNIFK

SEQ ID NO: 1153 - protein, 15 aa, Artificial Sequence
  Description of Artificial Sequence: Synthetic peptide
CFFGAIWGLLKNIFK

SEQ ID NO: 1154 - protein, 16 aa, Artificial Sequence
  Description of Artificial Sequence: Synthetic peptide
CGFFGAIWGLLKNIFK

SEQ ID NO: 1155 - protein, 15 aa, Artificial Sequence
  Description of Artificial Sequence: Synthetic peptide
CIFGAIWGLLKNIFK

SEQ ID NO: 1156 - protein, 32 aa, Artificial Sequence
  Description of Artificial Sequence: Synthetic polypeptide
CGIFGAIWIGLLKNIFKGIFGAIWGLLKNIFK

SEQ ID NO: 1157 - protein, 16 aa, Artificial Sequence
  Description of Artificial Sequence: Synthetic peptide
CGIFGAIWGLLHNIFH

SEQ ID NO: 1158 - protein, 16 aa, Artificial Sequence
  Description of Artificial Sequence: Synthetic peptide
  MOD_RES (12)..(12): Ornithine
  MOD_RES (16)..(16): Ornithine
CGIFGAIWGLLXNIFX

SEQ ID NO: 1159 - protein, 16 aa, Artificial Sequence
  Description of Artificial Sequence: Synthetic peptide
CGIFGAIAGLLHSILK

SEQ ID NO: 1160 - protein, 16 aa, Artificial Sequence
  Description of Artificial Sequence: Synthetic peptide
CGIFGAIWGLLHSILK

SEQ ID NO: 1161 - protein, 15 aa, Artificial Sequence
  Description of Artificial Sequence: Synthetic peptide
CGIFGAIAGLLHSIL

SEQ ID NO: 1162 - protein, 15 aa, Artificial Sequence
  Description of Artificial Sequence: Synthetic peptide
CGIFGAIWGLLHSIL

SEQ ID NO: 1163 - protein, 16 aa, Artificial Sequence
  Description of Artificial Sequence: Synthetic peptide
CGIFGAIWELLKNIFK

SEQ ID NO: 1164 - protein, 31 aa, Artificial Sequence
  Description of Artificial Sequence: Synthetic polypeptide
CGIFGAIWGLLHNIFHGIFGAIWGLLHNIFK

SEQ ID NO: 1165 - protein, 31 aa, Artificial Sequence
  Description of Artificial Sequence: Synthetic polypeptide
CGIFEAIWGLLHNIFHGIFEAIWGLLHNIFH

SEQ ID NO: 1166 - protein, 31 aa, Artificial Sequence
  Description of Artificial Sequence: Synthetic polypeptide
CGIFEAIWGLLKNIFHGIFEAIWGLLHNIFH

SEQ ID NO: 1167 - protein, 31 aa, Artificial Sequence
  Description of Artificial Sequence: Synthetic polypeptide
CGIFEAIWGLLKNIFKGIFEAIWELLKNIFH

SEQ ID NO: 1168 - protein, 31 aa, Artificial Sequence
  Description of Artificial Sequence: Synthetic polypeptide
CGIFEAIWGLLKNIFHGIFEAIWGLLKNIFH

SEQ ID NO: 1169 - protein, 24 aa, Artificial Sequence
  Description of Artificial Sequence: Synthetic peptide
CGLFEALLELLESLWELLLEAWNG

SEQ ID NO: 1170 - protein, 24 aa, Artificial Sequence
  Description of Artificial Sequence: Synthetic peptide
CGLFEALLELLESLWELLLEWWNG

SEQ ID NO: 1171 - protein, 24 aa, Artificial Sequence
  Description of Artificial Sequence: Synthetic peptide
CGLFGELEELLEEGLENLLDWWNG

SEQ ID NO: 1172 - protein, 24 aa, Artificial Sequence
  Description of Artificial Sequence: Synthetic peptide
CGLFGELEELLEEGLENLLEWWNG

SEQ ID NO: 1173 - protein, 24 aa, Artificial Sequence
  Description of Artificial Sequence: Synthetic peptide
CGLFGELEELLEEGWELLLEAWNG

SEQ ID NO: 1174 - protein, 24 aa, Artificial Sequence
  Description of Artificial Sequence: Synthetic peptide
CGLFGELEELLEEGWELLLEWWNG

SEQ ID NO: 1175 - protein, 24 aa, Artificial Sequence
  Description of Artificial Sequence: Synthetic peptide
CGLFGELEELLEEGWELLLDWWNG

SEQ ID NO: 1176 - protein, 24 aa, Artificial Sequence
  Description of Artificial Sequence: Synthetic peptide
CGLFGALLELLEEGLENLIDWWNG

SEQ ID NO: 1177 - protein, 24 aa, Artificial Sequence
  Description of Artificial Sequence: Synthetic peptide
CGLFEALLELLEEGLENLIDWWNG

SEQ ID NO: 1178 - protein, 24 aa, Artificial Sequence
  Description of Artificial Sequence: Synthetic peptide
CGLFEALLELLESLLENLIDWWNG

SEQ ID NO: 1179 - protein, 24 aa, Artificial Sequence
  Description of Artificial Sequence: Synthetic peptide
CGLFGELAELLEEGLENLLDWWNG

SEQ ID NO: 1180 - protein, 23 aa, Artificial Sequence
  Description of Artificial Sequence: Synthetic peptide
GLFGEIEELIEEGLENLIDWWNG

SEQ ID NO: 1181 - protein, 14 aa, Artificial Sequence
  Description of Artificial Sequence: Synthetic peptide
CFFGNIWEFIHSIL

SEQ ID NO: 1182 - protein, 14 aa, Artificial Sequence
  Description of Artificial Sequence: Synthetic peptide
CFFGAIWNFIHSIL

SEQ ID NO: 1183 - protein, 14 aa, Artificial Sequence
  Description of Artificial Sequence: Synthetic peptide
CFFGNIWNFIHSIL

SEQ ID NO: 1184 - protein, 16 aa, Artificial Sequence
  Description of Artificial Sequence: Synthetic peptide
CGIFGNIWNFIKNIFK

SEQ ID NO: 1185 - protein, 16 aa, Artificial Sequence
  Description of Artificial Sequence: Synthetic peptide
CGIFGNIWNLLKNIFK

SEQ ID NO: 1186 - protein, 16 aa, Artificial Sequence
  Description of Artificial Sequence: Synthetic peptide
CGIFGNIWGLLKNIFK

SEQ ID NO: 1187 - protein, 16 aa, Artificial Sequence
  Description of Artificial Sequence: Synthetic peptide
CGIFGNIWNFIKNIFH

SEQ ID NO: 1188 - protein, 16 aa, Artificial Sequence
  Description of Artificial Sequence: Synthetic peptide
CGIFGNIWNLLKNIFH

SEQ ID NO: 1189 - protein, 16 aa, Artificial Sequence
  Description of Artificial Sequence: Synthetic peptide
CGIFGNIWGLLKNIFH

SEQ ID NO: 1190 - protein, 16 aa, Artificial Sequence
  Description of Artificial Sequence: Synthetic peptide
CGIFENIWNFIKNIFK

SEQ ID NO: 1191 - protein, 16 aa, Artificial Sequence
  Description of Artificial Sequence: Synthetic peptide
CGIFENIWNFIKNIFH

SEQ ID NO: 1192 - protein, 16 aa, Artificial Sequence
  Description of Artificial Sequence: Synthetic peptide
CGIFENIWGLLKNIFK

SEQ ID NO: 1193 - protein, 16 aa, Artificial Sequence
  Description of Artificial Sequence: Synthetic peptide
CGIFENIWGLLKNIFH

SEQ ID NO: 1194 - protein, 16 aa, Artificial Sequence
  Description of Artificial Sequence: Synthetic peptide
CGIFENIWNLLKNIFK

SEQ ID NO: 1195 - protein, 16 aa, Artificial Sequence
  Description of Artificial Sequence: Synthetic peptide
CGIFENIWNLLKNIFH

SEQ ID NO: 1196 - protein, 24 aa, Artificial Sequence
  Description of Artificial Sequence: Synthetic peptide
CGLFGAIAGLLENIFENLIDWWNG

SEQ ID NO: 1197 - protein, 24 aa, Artificial Sequence
  Description of Artificial Sequence: Synthetic peptide
CGLFGAIAGLLNKIFKNLIDWWNG

SEQ ID NO: 1198 - protein, 24 aa, Artificial Sequence
  Description of Artificial Sequence: Synthetic peptide
CGLFGAIAGLLENIFKNLIDWWNG

SEQ ID NO: 1199 - protein, 24 aa, Artificial Sequence
  Description of Artificial Sequence: Synthetic peptide
CGLFGAIAGLLKNIFENLIDWWNG

SEQ ID NO: 1200 - protein, 24 aa, Artificial Sequence
  Description of Artificial Sequence: Synthetic peptide
CGLFGAIAGLLKNIFHNLIDWWNG

SEQ ID NO: 1201 - protein, 27 aa, Artificial Sequence
  Description of Artificial Sequence: Synthetic peptide
CLIGAILKVLATGLPTLISWIKNKRKQ

SEQ ID NO: 1202 - protein, 24 aa, Artificial Sequence
  Description of Artificial Sequence: Synthetic peptide
CGLLEEIEELLEEGLENLIDWWNG

SEQ ID NO: 1203 - protein, 24 aa, Artificial Sequence
  Description of Artificial Sequence: Synthetic peptide
CGLFEELEELLEEGLENLIDWWNG

SEQ ID NO: 1204 - protein, 21 aa, Artificial Sequence
  Description of Artificial Sequence: Synthetic peptide
CGLFEELEELLEEGLENLIEA

SEQ ID NO: 1205 - protein, 24 aa, Artificial Sequence
  Description of Artificial Sequence: Synthetic peptide
CGLFEELEELLEEGLENLIEAWNG

SEQ ID NO: 1206 - protein, 21 aa, Artificial Sequence
  Description of Artificial Sequence: Synthetic peptide
CGLFEELEELLEEGLENLIEW

SEQ ID NO: 1207 - protein, 24 aa, Artificial Sequence
  Description of Artificial Sequence: Synthetic peptide
CGLFEELEELLEEGLENLIEWWNG

SEQ ID NO: 1208 - protein, 21 aa, Artificial Sequence
  Description of Artificial Sequence: Synthetic peptide
CGLFEELEELLEEGLENLIDA

SEQ ID NO: 1209 - protein, 24 aa, Artificial Sequence
  Description of Artificial Sequence: Synthetic peptide
CGLFEELEELLEEGLENLIDAWNG

SEQ ID NO: 1210 - protein, 21 aa, Artificial Sequence
  Description of Artificial Sequence: Synthetic peptide
CGLFEELEELLEEGLENLIDW

SEQ ID NO: 1211 - protein, 14 aa, Artificial Sequence
  Description of Artificial Sequence: Synthetic peptide
CFLGALKFALKSLL

SEQ ID NO: 1212 - protein, 14 aa, Artificial Sequence
  Description of Artificial Sequence: Synthetic peptide
CFLGALHFALKSLL

SEQ ID NO: 1213 - protein, 14 aa, Artificial Sequence
  Description of Artificial Sequence: Synthetic peptide
CFLGALKFALHSLL

SEQ ID NO: 1214 - protein, 14 aa, Artificial Sequence
  Description of Artificial Sequence: Synthetic peptide
CFLGALHFALHSLL

SEQ ID NO: 1215 - protein, 14 aa, Artificial Sequence
  Description of Artificial Sequence: Synthetic peptide
FLGALKFALKSLLC

SEQ ID NO: 1216 - protein, 15 aa, Artificial Sequence
  Description of Artificial Sequence: Synthetic peptide
GFLGALKFALKSLLC

SEQ ID NO: 1217 - protein, 24 aa, Artificial Sequence
  Description of Artificial Sequence: Synthetic peptide
CGLFGELEELIEEGLENLLDWWNG

SEQ ID NO: 1218 - protein, 24 aa, Artificial Sequence
  Description of Artificial Sequence: Synthetic peptide
CGLFGEIEELLEEGLENLLDWWNG

SEQ ID NO: 1219 - protein, 24 aa, Artificial Sequence
  Description of Artificial Sequence: Synthetic peptide
CGLFGELEELLEEGLENLIDWWNG

SEQ ID NO: 1220 - protein, 24 aa, Artificial Sequence
  Description of Artificial Sequence: Synthetic peptide
CGLFGEIEELIEEGLENLMDWWNG

SEQ ID NO: 1221 - protein, 24 aa, Artificial Sequence
  Description of Artificial Sequence: Synthetic peptide
CGLFGEIEELIEEGLENLEDWWNG

SEQ ID NO: 1222 - protein, 24 aa, Artificial Sequence
  Description of Artificial Sequence: Synthetic peptide
CGLFGEIEELIEEGLENLDDWWNG

SEQ ID NO: 1223 - protein, 24 aa, Artificial Sequence
  Description of Artificial Sequence: Synthetic peptide
CGLFGEIEELIEEGLENLNDWWNG

SEQ ID NO: 1224 - protein, 24 aa, Artificial Sequence
  Description of Artificial Sequence: Synthetic peptide
CGLFGEIEELIEEGLENLSDWWNG

SEQ ID NO: 1225 - protein, 24 aa, Artificial Sequence
  Description of Artificial Sequence: Synthetic peptide
CGLFGEIEELIEEGLENLQDWWNG

SEQ ID NO: 1226 - protein, 24 aa, Artificial Sequence
  Description of Artificial Sequence: Synthetic peptide
  MOD_RES (19)..(19): Cit
CGLFGEIEELIEEGLENLXDWWNG

SEQ ID NO: 1227 - protein, 24 aa, Artificial Sequence
  Description of Artificial Sequence: Synthetic peptide
CGLFGEIEELIEELLENLIDWWNG

SEQ ID NO: 1228 - protein, 24 aa, Artificial Sequence
  Description of Artificial Sequence: Synthetic peptide
CGLFGEIEELIEEILENLIDWWNG

SEQ ID NO: 1229 - protein, 24 aa, Artificial Sequence
  Description of Artificial Sequence: Synthetic peptide
CGLFGEIEELIEEVLENLIDWWNG

SEQ ID NO: 1230 - protein, 14 aa, Artificial Sequence
  Description of Artificial Sequence: Synthetic peptide
CFLGALWKLLSHLL

SEQ ID NO: 1231 - protein, 14 aa, Artificial Sequence
  Description of Artificial Sequence: Synthetic peptide
CFLGALWKILSHLL

SEQ ID NO: 1232 - protein, 15 aa, Artificial Sequence
  Description of Artificial Sequence: Synthetic peptide
CFLGALWVKVLSHLL

SEQ ID NO: 1233 - protein, 14 aa, Artificial Sequence
  Description of Artificial Sequence: Synthetic peptide
CFLGALWKFLSHLL

SEQ ID NO: 1234 - protein, 14 aa, Artificial Sequence
  Description of Artificial Sequence: Synthetic peptide
CFLEALWKALSHLL

SEQ ID NO: 1235 - protein, 14 aa, Artificial Sequence
  Description of Artificial Sequence: Synthetic peptide
CFLHALWKALSHLL

SEQ ID NO: 1236 - protein, 14 aa, Artificial Sequence
  Description of Artificial Sequence: Synthetic peptide
CFLKALWKALSHLL

SEQ ID NO: 1237 - protein, 14 aa, Artificial Sequence
  Description of Artificial Sequence: Synthetic peptide
CFLNALWKALSHLL

SEQ ID NO: 1238 - protein, 14 aa, Artificial Sequence
  Description of Artificial Sequence: Synthetic peptide
CFLSALWKALSHLL

SEQ ID NO: 1239 - protein, 14 aa, Artificial Sequence
  Description of Artificial Sequence: Synthetic peptide
CFLQALWKALSHLL

SEQ ID NO: 1240 - protein, 14 aa, Artificial Sequence
  Description of Artificial Sequence: Synthetic peptide
CFLEALWEALSHLL

SEQ ID NO: 1241 - protein, 14 aa, Artificial Sequence
  Description of Artificial Sequence: Synthetic peptide
CFLGALWEALSHLL

SEQ ID NO: 1242 - protein, 14 aa, Artificial Sequence
  Description of Artificial Sequence: Synthetic peptide
CFLEALWKLLSHLL

SEQ ID NO: 1243 - protein, 14 aa, Artificial Sequence
  Description of Artificial Sequence: Synthetic peptide
CFLEALWEALEELL

SEQ ID NO: 1244 - protein, 14 aa, Artificial Sequence
  Description of Artificial Sequence: Synthetic peptide
CFLEELWEALEELL

SEQ ID NO: 1245 - protein, 14 aa, Artificial Sequence
  Description of Artificial Sequence: Synthetic peptide
CFLEALWEALEHLL

SEQ ID NO: 1246 - protein, 14 aa, Artificial Sequence
  Description of Artificial Sequence: Synthetic peptide
CFLEELWEALEHLL

SEQ ID NO: 1247 - protein, 14 aa, Artificial Sequence
  Description of Artificial Sequence: Synthetic peptide
CFLEELWELLEELL

SEQ ID NO: 1248 - protein, 14 aa, Artificial Sequence
  Description of Artificial Sequence: Synthetic peptide
CFLEELWELLEHLL

SEQ ID NO: 1249 - protein, 24 aa, Artificial Sequence
  Description of Artificial Sequence: Synthetic peptide
  MOD_RES (17)..(17): Cit
CGLFGEIEELLEEGLEXLIDWWNG

SEQ ID NO: 1250 - protein, 24 aa, Artificial Sequence
  Description of Artificial Sequence: Synthetic peptide
  MOD_RES (17)..(17): Cit
CGLFEEIEELLEEGLEXLIDWWNG

SEQ ID NO: 1251 - protein, 24 aa, Artificial Sequence
  Description of Artificial Sequence: Synthetic peptide
  MOD_RES (17)..(17): Cit
CGLFGEIAELLEEGLEXLIDWWNG

SEQ ID NO: 1252 - protein, 24 aa, Artificial Sequence
  Description of Artificial Sequence: Synthetic peptide
  MOD_RES (17)..(17): Cit
CGLFEEIAELLEEGLEXLIDWWNG

SEQ ID NO: 1253 - protein, 24 aa, Artificial Sequence
  Description of Artificial Sequence: Synthetic peptide
  MOD_RES (17)..(17): Cit
CGLFGEIEELLEEGLEXLVDWWNG

SEQ ID NO: 1254 - protein, 24 aa, Artificial Sequence
  Description of Artificial Sequence: Synthetic peptide
  MOD_RES (17)..(17): Cit
CGLFEEIEELLEEGLEXLVDWWNG

SEQ ID NO: 1255 - protein, 24 aa, Artificial Sequence
  Description of Artificial Sequence: Synthetic peptide
  MOD_RES (17)..(17): Cit
CGLFGEIAELLEEGLEXLVDWWNG

SEQ ID NO: 1256 - protein, 24 aa, Artificial Sequence
  Description of Artificial Sequence: Synthetic peptide
  MOD_RES (17)..(17): Cit
CGLFEEIAELLEEGLEXLVDWWNG

SEQ ID NO: 1257 - protein, 24 aa, Artificial Sequence
  Description of Artificial Sequence: Synthetic peptide
  MOD_RES (17)..(17): Cit
CGLFGEIEELLEEGLEXLIDWWNE

SEQ ID NO: 1258 - protein, 24 aa, Artificial Sequence
  Description of Artificial Sequence: Synthetic peptide
  MOD_RES (17)..(17): Cit
CGLFEEIEELLEEGLEXLIDWWNE

SEQ ID NO: 1259 - protein, 24 aa, Artificial Sequence
  Description of Artificial Sequence: Synthetic peptide
  MOD_RES (17)..(17): Cit
CGLFGEIAELLEEGLEXLIDWWNE

SEQ ID NO: 1260 - protein, 24 aa, Artificial Sequence
  Description of Artificial Sequence: Synthetic peptide
  MOD_RES (17)..(17): Cit
CGLFEEIAELLEEGLEXLIDWWNE

SEQ ID NO: 1261 - protein, 24 aa, Artificial Sequence
  Description of Artificial Sequence: Synthetic peptide
  MOD_RES (17)..(17): Cit
CGLFGEIEELLEEGLHXLIDWWNG

SEQ ID NO: 1262 - protein, 24 aa, Artificial Sequence
  Description of Artificial Sequence: Synthetic peptide
  MOD_RES (17)..(17): Cit
CGLFEEIEELLEEGLHXLIDWWNG

SEQ ID NO: 1263 - protein, 24 aa, Artificial Sequence
  Description of Artificial Sequence: Synthetic peptide
  MOD_RES (17)..(17): Cit
CGLFGEIAELLEEGLHXLIDWWNG

SEQ ID NO: 1264 - protein, 24 aa, Artificial Sequence
  Description of Artificial Sequence: Synthetic peptide
  MOD_RES (17)..(17): Cit
CGLFEEIAELLEEGLHXLIDWWNG

SEQ ID NO: 1265 - protein, 24 aa, Artificial Sequence
  Description of Artificial Sequence: Synthetic peptide
  MOD_RES (17)..(17): Cit
CGLFGEIEELLEEGLEXLVDWWNE

SEQ ID NO: 1266 - protein, 24 aa, Artificial Sequence
  Description of Artificial Sequence: Synthetic peptide
  MOD_RES (17)..(17): Cit
CGLFEEIEELLEEGLEXLVDWWNE

SEQ ID NO: 1267 - protein, 24 aa, Artificial Sequence
  Description of Artificial Sequence: Synthetic peptide
  MOD_RES (17)..(17): Cit
CGLFGEIAELLEEGLEXLVDWWNE

SEQ ID NO: 1268 - protein, 24 aa, Artificial Sequence
  Description of Artificial Sequence: Synthetic peptide
  MOD_RES (17)..(17): Cit
CGLFEEIAELLEEGLEXLVDWWNE

SEQ ID NO: 1269 - protein, 14 aa, Artificial Sequence
  Description of Artificial Sequence: Synthetic peptide
CFFKNIWEFIKSIL

SEQ ID NO: 1270 - protein, 14 aa, Artificial Sequence
  Description of Artificial Sequence: Synthetic peptide
CFFKNIWNFIKSIL

SEQ ID NO: 1271 - protein, 15 aa, Artificial Sequence
  Description of Artificial Sequence: Synthetic peptide
CFFKAIWEFIKSILE

SEQ ID NO: 1272 - protein, 15 aa, Artificial Sequence
  Description of Artificial Sequence: Synthetic peptide
CFFKAIWEFIKNIFK

SEQ ID NO: 1273 - protein, 16 aa, Artificial Sequence
  Description of Artificial Sequence: Synthetic peptide
CFFKAIWEFIKNIFKE

SEQ ID NO: 1274 - protein, 14 aa, Artificial Sequence
  Description of Artificial Sequence: Synthetic peptide
CFFKAIWELLKSIL

SEQ ID NO: 1275 - protein, 14 aa, Artificial Sequence
  Description of Artificial Sequence: Synthetic peptide
CFFKAIWGLLKSIL

SEQ ID NO: 1276 - protein, 15 aa, Artificial Sequence
  Description of Artificial Sequence: Synthetic peptide
CFFKAIWEFIKSILK

SEQ ID NO: 1277 - protein, 14 aa, Artificial Sequence
  Description of Artificial Sequence: Synthetic peptide
CFFKNIWGLLKSIL

SEQ ID NO: 1278 - protein, 15 aa, Artificial Sequence
  Description of Artificial Sequence: Synthetic peptide
CFFKAIWGLLKNIFK

SEQ ID NO: 1279 - protein, 15 aa, Artificial Sequence
  Description of Artificial Sequence: Synthetic peptide
CFFKAIWELLKNIFK

SEQ ID NO: 1280 - protein, 15 aa, Artificial Sequence
  Description of Artificial Sequence: Synthetic peptide
CFFKNIWGLLKNIFK

SEQ ID NO: 1281 - protein, 15 aa, Artificial Sequence
  Description of Artificial Sequence: Synthetic peptide
CFFKNIWELLKNIFK

SEQ ID NO: 1282 - protein, 14 aa, Artificial Sequence
  Description of Artificial Sequence: Synthetic peptide
CFFKAIWEFIRSIL

SEQ ID NO: 1283 - protein, 14 aa, Artificial Sequence
  Description of Artificial Sequence: Synthetic peptide
CFFKAIWEFIKSLL

SEQ ID NO: 1284 - protein, 14 aa, Artificial Sequence
  Description of Artificial Sequence: Synthetic peptide
CFFKAIWEFIKSAL

SEQ ID NO: 1285 - protein, 14 aa, Artificial Sequence
  Description of Artificial Sequence: Synthetic peptide
CFFKAIWEFIKSIF

SEQ ID NO: 1286 - protein, 14 aa, Artificial Sequence
  Description of Artificial Sequence: Synthetic peptide
CFFKALWEFLKSLL

SEQ ID NO: 1287 - protein, 14 aa, Artificial Sequence
  Description of Artificial Sequence: Synthetic peptide
CIFKAIWEFIKSIL

SEQ ID NO: 1288 - protein, 14 aa, Artificial Sequence
  Description of Artificial Sequence: Synthetic peptide
CFFKAIWEFIKSIW

SEQ ID NO: 1289 - protein, 14 aa, Artificial Sequence
  Description of Artificial Sequence: Synthetic peptide
CFFHAIWEFIKSIL

SEQ ID NO: 1290 - protein, 14 aa, Artificial Sequence
  Description of Artificial Sequence: Synthetic peptide
CFFEAIWEFIKSIL

SEQ ID NO: 1291 - protein, 14 aa, Artificial Sequence
  Description of Artificial Sequence: Synthetic peptide
CFFKAIAEFIKSIL

SEQ ID NO: 1292 - protein, 14 aa, Artificial Sequence
  Description of Artificial Sequence: Synthetic peptide
CFFKAIEEFIKSIL

SEQ ID NO: 1293 - protein, 14 aa, Artificial Sequence
  Description of Artificial Sequence: Synthetic peptide
CFFKAILEFIKSIL

SEQ ID NO: 1294 - protein, 14 aa, Artificial Sequence
  Description of Artificial Sequence: Synthetic peptide
CFFKAIFEFIKSIL

SEQ ID NO: 1295 - protein, 14 aa, Artificial Sequence
  Description of Artificial Sequence: Synthetic peptide
CFFKAIWGFIKSIL

SEQ ID NO: 1296 - protein, 14 aa, Artificial Sequence
  Description of Artificial Sequence: Synthetic peptide
CFFKAIWHFIKSIL

SEQ ID NO: 1297 - protein, 14 aa, Artificial Sequence
  Description of Artificial Sequence: Synthetic peptide
CFFKAIWKFIKSIL

SEQ ID NO: 1298 - protein, 14 aa, Artificial Sequence
  Description of Artificial Sequence: Synthetic peptide
CFFEAIWKFIKSIL

SEQ ID NO: 1299 - protein, 14 aa, Artificial Sequence
  Description of Artificial Sequence: Synthetic peptide
CFFKAIWELIKSIL

SEQ ID NO: 1300 - protein, 14 aa, Artificial Sequence
  Description of Artificial Sequence: Synthetic peptide
CFFKALWELLKSLL

SEQ ID NO: 1301 - protein, 14 aa, Artificial Sequence
  Description of Artificial Sequence: Synthetic peptide
CFFKAIWEAIKSIL

SEQ ID NO: 1302 - protein, 14 aa, Artificial Sequence
  Description of Artificial Sequence: Synthetic peptide
CFFKAIWEFLKSIL

SEQ ID NO: 1303 - protein, 14 aa, Artificial Sequence
  Description of Artificial Sequence: Synthetic peptide
CFFKAIWEFIHSIL

SEQ ID NO: 1304 - protein, 14 aa, Artificial Sequence
  Description of Artificial Sequence: Synthetic peptide
CFFKAIWEFIESIL

SEQ ID NO: 1305 - protein, 14 aa, Artificial Sequence
  Description of Artificial Sequence: Synthetic peptide
CFFKAIWEFIKNIL

SEQ ID NO: 1306 - protein, 14 aa, Artificial Sequence
  Description of Artificial Sequence: Synthetic peptide
CFFKAIWEFIKWIL

SEQ ID NO: 1307 - protein, 14 aa, Artificial Sequence
  Description of Artificial Sequence: Synthetic peptide
CFFKAIWEFIKEIL

SEQ ID NO: 1308 - protein, 14 aa, Artificial Sequence
  Description of Artificial Sequence: Synthetic peptide
CFFKAIWEFIKGIL

SEQ ID NO: 1309 - protein, 14 aa, Artificial Sequence
  Description of Artificial Sequence: Synthetic peptide
CFFKAIWEFIKSGL

SEQ ID NO: 1310 - protein, 14 aa, Artificial Sequence
  Description of Artificial Sequence: Synthetic peptide
CFFKAIWEFIKSII

SEQ ID NO: 1311 - protein, 14 aa, Artificial Sequence
  Description of Artificial Sequence: Synthetic peptide
  MOD_RES (12)..(12): Cit
CFFKAIWEFIKXIL

SEQ ID NO: 1312 - protein, 14 aa, Artificial Sequence
  Description of Artificial Sequence: Synthetic peptide
CFFKAIWEFIKSIA

SEQ ID NO: 1313 - protein, 14 aa, Artificial Sequence
  Description of Artificial Sequence: Synthetic peptide
CFFKAIWEFIKQIL

SEQ ID NO: 1314 - protein, 15 aa, Artificial Sequence
  Description of Artificial Sequence: Synthetic peptide
CGFFKAIWEFIKSIL

SEQ ID NO: 1315 - protein, 20 aa, Artificial Sequence
  Description of Artificial Sequence: Synthetic peptide
CFFKAIWEFIKSILKGLIDG

SEQ ID NO: 1316 - protein, 23 aa, Artificial Sequence
  Description of Artificial Sequence: Synthetic peptide
CFFKAIWEFIKSILKGLIDGWYG

SEQ ID NO: 1317 - protein, 20 aa, Artificial Sequence
  Description of Artificial Sequence: Synthetic peptide
CFFKAIWEFIKSILEGLIDG

SEQ ID NO: 1318 - protein, 23 aa, Artificial Sequence
  Description of Artificial Sequence: Synthetic peptide
CFFKAIWEFIKSILEGLIDGWYG

SEQ ID NO: 1319 - protein, 20 aa, Artificial Sequence
  Description of Artificial Sequence: Synthetic peptide
CFFKAIWEFIKNIFKGLIDG

SEQ ID NO: 1320 - protein, 23 aa, Artificial Sequence
  Description of Artificial Sequence: Synthetic peptide
CFFKAIWEFIKNIFKGLIDGWYG

SEQ ID NO: 1321 - protein, 20 aa, Artificial Sequence
  Description of Artificial Sequence: Synthetic peptide
CFFGNIWEFIKSILKGLIDG

SEQ ID NO: 1322 - protein, 23 aa, Artificial Sequence
  Description of Artificial Sequence: Synthetic peptide
CFFGNIWEFIKSILKGLIDGWYG

SEQ ID NO: 1323 - protein, 20 aa, Artificial Sequence
  Description of Artificial Sequence: Synthetic peptide
CFFGNIWEFIKSILEGLIDG

SEQ ID NO: 1324 - protein, 23 aa, Artificial Sequence
  Description of Artificial Sequence: Synthetic peptide
CFFGNIWEFIKSILEGLIDGWYG

SEQ ID NO: 1325 - protein, 20 aa, Artificial Sequence
  Description of Artificial Sequence: Synthetic peptide
CFFGNIWEFIKNIFKGLIDG

SEQ ID NO: 1326 - protein, 23 aa, Artificial Sequence
  Description of Artificial Sequence: Synthetic peptide
CFFGNIWEFIKNIFKGLIDGEYG

SEQ ID NO: 1327 - protein, 20 aa, Artificial Sequence
  Description of Artificial Sequence: Synthetic peptide
CFFKAIWGLLKSILKGLIDG

SEQ ID NO: 1328 - protein, 23 aa, Artificial Sequence
  Description of Artificial Sequence: Synthetic peptide
CFFKAIWGLLKSILKGLIDGWYG

SEQ ID NO: 1329 - protein, 20 aa, Artificial Sequence
  Description of Artificial Sequence: Synthetic peptide
CFFKAIWGLLKSILEGLIDG

SEQ ID NO: 1330 - protein, 23 aa, Artificial Sequence
  Description of Artificial Sequence: Synthetic peptide
CFFKAIWGLLKSILEGLIDGWYG

SEQ ID NO: 1331 - protein, 20 aa, Artificial Sequence
  Description of Artificial Sequence: Synthetic peptide
CFFKAIWGLLKNIFKGLIDG

SEQ ID NO: 1332 - protein, 23 aa, Artificial Sequence
  Description of Artificial Sequence: Synthetic peptide
CFFKAIWGLLKNIFKGLIDGWYG

SEQ ID NO: 1333 - protein, 20 aa, Artificial Sequence
  Description of Artificial Sequence: Synthetic peptide
CFFKAIWGLLKNIFEGLIDG

SEQ ID NO: 1334 - protein, 23 aa, Artificial Sequence
  Description of Artificial Sequence: Synthetic peptide
CFFKAIWGLLKNIFEGLIDGWYG

SEQ ID NO: 1335 - protein, 23 aa, Artificial Sequence
  Description of Artificial Sequence: Synthetic peptide
CFFKAIWEFIKSILKGLIDGWNG

SEQ ID NO: 1336 - protein, 23 aa, Artificial Sequence
  Description of Artificial Sequence: Synthetic peptide
CFFKAIWEFIKNIFKGLIDGWNG

SEQ ID NO: 1337 - protein, 20 aa, Artificial Sequence
  Description of Artificial Sequence: Synthetic peptide
CIFGAIAGLLKNILKGLIDG

SEQ ID NO: 1338 - protein, 23 aa, Artificial Sequence
  Description of Artificial Sequence: Synthetic peptide
CIFGAIAGLLKNILKGLIDGWYG

SEQ ID NO: 1339 - protein, 14 aa, Artificial Sequence
  Description of Artificial Sequence: Synthetic peptide
CFLEALWKALEHLL

SEQ ID NO: 1340 - protein, 14 aa, Artificial Sequence
  Description of Artificial Sequence: Synthetic peptide
CFLEALWEALSKLL

SEQ ID NO: 1341 - protein, 14 aa, Artificial Sequence
  Description of Artificial Sequence: Synthetic peptide
CFLEALWEALEKLL

SEQ ID NO: 1342 - protein, 15 aa, Artificial Sequence
  Description of Artificial Sequence: Synthetic peptide
CFLEALWEALEHLLK

SEQ ID NO: 1343 - protein, 14 aa, Artificial Sequence
  Description of Artificial Sequence: Synthetic peptide
FLEALWEALEHLLC

SEQ ID NO: 1344 - protein, 15 aa, Artificial Sequence
  Description of Artificial Sequence: Synthetic peptide
GFLEALWEALEHLLC

SEQ ID NO: 1345 - protein, 14 aa, Artificial Sequence
  Description of Artificial Sequence: Synthetic peptide
CFLEALWKALSKLL

SEQ ID NO: 1346 - protein, 14 aa, Artificial Sequence
  Description of Artificial Sequence: Synthetic peptide
CFLEALWEALDHLL

SEQ ID NO: 1347 - protein, 14 aa, Artificial Sequence
  Description of Artificial Sequence: Synthetic peptide
CFLEALWEALTHLL

SEQ ID NO: 1348 - protein, 14 aa, Artificial Sequence
  Description of Artificial Sequence: Synthetic peptide
CFLEALWEALNHLL

SEQ ID NO: 1349 - protein, 14 aa, Artificial Sequence
  Description of Artificial Sequence: Synthetic peptide
CFLEALWEALQHLL

SEQ ID NO: 1350 - protein, 15 aa, Artificial Sequence
  Description of Artificial Sequence: Synthetic peptide
CFLEALWEALEHLLH

SEQ ID NO: 1351 - protein, 15 aa, Artificial Sequence
  Description of Artificial Sequence: Synthetic peptide
CFLEALWEALEHLLK

SEQ ID NO: 1352 - protein, 15 aa, Artificial Sequence
  Description of Artificial Sequence: Synthetic peptide
CFLEALWEALEHLLE

SEQ ID NO: 1353 - protein, 13 aa, Artificial Sequence
  Description of Artificial Sequence: Synthetic peptide
CWLEALEALEHLL

SEQ ID NO: 1354 - protein, 14 aa, Artificial Sequence
  Description of Artificial Sequence: Synthetic peptide
CLLEALWEALEHLL

SEQ ID NO: 1355 - protein, 14 aa, Artificial Sequence
  Description of Artificial Sequence: Synthetic peptide
CFFEALWEALEHLL

SEQ ID NO: 1356 - protein, 14 aa, Artificial Sequence
  Description of Artificial Sequence: Synthetic peptide
CFLEALEEALEHLL

SEQ ID NO: 1357 - protein, 14 aa, Artificial Sequence
  Description of Artificial Sequence: Synthetic peptide
CFLEALAEALEHLL

SEQ ID NO: 1358 - protein, 14 aa, Artificial Sequence
  Description of Artificial Sequence: Synthetic peptide
CFLEALFEALEHLL

SEQ ID NO: 1359 - protein, 14 aa, Artificial Sequence
  Description of Artificial Sequence: Synthetic peptide
CLFEALWEALHHLL

SEQ ID NO: 1360 - protein, 14 aa, Artificial Sequence
  Description of Artificial Sequence: Synthetic peptide
CLFEALWEALKHLL

SEQ ID NO: 1361 - protein, 14 aa, Artificial Sequence
  Description of Artificial Sequence: Synthetic peptide
CFLEALWEALEHGL

SEQ ID NO: 1362 - protein, 14 aa, Artificial Sequence
  Description of Artificial Sequence: Synthetic peptide
CLFEALWEALEHLF

SEQ ID NO: 1363 - protein, 14 aa, Artificial Sequence
  Description of Artificial Sequence: Synthetic peptide
CLFEALWEALEHFL

SEQ ID NO: 1364 - protein, 23 aa, Artificial Sequence
  Description of Artificial Sequence: Synthetic peptide
CLFEALWEALEHLLEGLIDWWYG

SEQ ID NO: 1365 - protein, 23 aa, Artificial Sequence
  Description of Artificial Sequence: Synthetic peptide
CLFEALWEALEHLLEGLIDWWNG

SEQ ID NO: 1366 - protein, 23 aa, Artificial Sequence
  Description of Artificial Sequence: Synthetic peptide
CLFEALWEALEHLLENLIDWWNG

SEQ ID NO: 1367 - protein, 14 aa, Artificial Sequence
  Description of Artificial Sequence: Synthetic peptide
CFLEELWELLEKLL

SEQ ID NO: 1368 - protein, 15 aa, Artificial Sequence
  Description of Artificial Sequence: Synthetic peptide
CFLEELWELLEELLE

SEQ ID NO: 1369 - protein, 18 aa, Artificial Sequence
  Description of Artificial Sequence: Synthetic peptide
CFLEELWELLEELLELLE

SEQ ID NO: 1370 - protein, 18 aa, Artificial Sequence
  Description of Artificial Sequence: Synthetic peptide
CFLEELWELLEHLLELLD

SEQ ID NO: 1371 - protein, 18 aa, Artificial Sequence
  Description of Artificial Sequence: Synthetic peptide
CFLEELWELLEELLELID

SEQ ID NO: 1372 - protein, 18 aa, Artificial Sequence
  Description of Artificial Sequence: Synthetic peptide
CFLEELWELLEELLELLD

SEQ ID NO: 1373 - protein, 18 aa, Artificial Sequence
  Description of Artificial Sequence: Synthetic peptide
CFLEELWELLEHLLEGLE

SEQ ID NO: 1374 - protein, 18 aa, Artificial Sequence
  Description of Artificial Sequence: Synthetic peptide
CFLEELWELLEHLLEGLD

SEQ ID NO: 1375 - protein, 19 aa, Artificial Sequence
  Description of Artificial Sequence: Synthetic peptide
CFLEELWELLEHLLEEGLI

SEQ ID NO: 1376 - protein, 23 aa, Artificial Sequence
  Description of Artificial Sequence: Synthetic peptide
CFLEELWELLEHLLEGLIDWWYG

SEQ ID NO: 1377 - protein, 23 aa, Artificial Sequence
  Description of Artificial Sequence: Synthetic peptide
CFLEELWELLEHLLENLIDWWNG

SEQ ID NO: 1378 - protein, 18 aa, Artificial Sequence
  Description of Artificial Sequence: Synthetic peptide
CFLEALWEALEHLLELLD

SEQ ID NO: 1379 - protein, 24 aa, Artificial Sequence
  Description of Artificial Sequence: Synthetic peptide
CGLFGELEELLEEGLENLTDWWNG

SEQ ID NO: 1380 - protein, 24 aa, Artificial Sequence
  Description of Artificial Sequence: Synthetic peptide
CGLFGELEELLEEGLENLIDWWNG

SEQ ID NO: 1381 - protein, 18 aa, Artificial Sequence
  Description of Artificial Sequence: Synthetic peptide
CFLEALWEALEHLLELID

SEQ ID NO: 1382 - protein, 24 aa, Artificial Sequence
  Description of Artificial Sequence: Synthetic peptide
CELFEELEELLEEGLENLIDWWNG

SEQ ID NO: 1383 - protein, 24 aa, Artificial Sequence
  Description of Artificial Sequence: Synthetic peptide
CGLFEELEELLEEGLELLIDWWNG

SEQ ID NO: 1384 - protein, 24 aa, Artificial Sequence
  Description of Artificial Sequence: Synthetic peptide
CGLFEELEELLEEGLELLIDWWNK

SEQ ID NO: 1385 - protein, 24 aa, Artificial Sequence
  Description of Artificial Sequence: Synthetic peptide
CGLFEELEELLEEGLENLIDWWNK

SEQ ID NO: 1386 - protein, 24 aa, Artificial Sequence
  Description of Artificial Sequence: Synthetic peptide
CGLFGELEELLEEGLENLIDWWNQ

SEQ ID NO: 1387 - protein, 24 aa, Artificial Sequence
  Description of Artificial Sequence: Synthetic peptide
CGLFGELEELLEEGLENLIDWWNE

SEQ ID NO: 1388 - protein, 24 aa, Artificial Sequence
  Description of Artificial Sequence: Synthetic peptide
CGLFGELEELLEEGLENLIDWWNN

SEQ ID NO: 1389 - protein, 24 aa, Artificial Sequence
  Description of Artificial Sequence: Synthetic peptide
CGLFGELEELLEEGLENLIDWWNS

SEQ ID NO: 1390 - protein, 24 aa, Artificial Sequence
  Description of Artificial Sequence: Synthetic peptide
CGLFEELEELLEEGLENLIDWWNQ

SEQ ID NO: 1391 - protein, 14 aa, Artificial Sequence
  Description of Artificial Sequence: Synthetic peptide
CFLEELWELLEHLL

SEQ ID NO: 1392 - protein, 14 aa, Artificial Sequence
  Description of Artificial Sequence: Synthetic peptide
CFLEELWELLEELL

SEQ ID NO: 1393 - protein, 24 aa, Artificial Sequence
  Description of Artificial Sequence: Synthetic peptide
CGLLGEIEELLEEGLENLIDWWNG

SEQ ID NO: 1394 - protein, 24 aa, Artificial Sequence
  Description of Artificial Sequence: Synthetic peptide
CGLLAEIEELLEEGLENLIDWWNG

SEQ ID NO: 1395 - protein, 24 aa, Artificial Sequence
  Description of Artificial Sequence: Synthetic peptide
CGLLGEIEELLEEGLENLIDWWNQ

SEQ ID NO: 1396 - protein, 24 aa, Artificial Sequence
  Description of Artificial Sequence: Synthetic peptide
CGLLAEIEELLEEGLENLIDWWNQ

SEQ ID NO: 1397 - protein, 24 aa, Artificial Sequence
  Description of Artificial Sequence: Synthetic peptide
CGLLEEIEELLEEGLENLIDWWNQ

SEQ ID NO: 1398 - protein, 24 aa, Artificial Sequence
  Description of Artificial Sequence: Synthetic peptide
CGLLGEIEELLEEGLENLIDWWNE

SEQ ID NO: 1399 - protein, 24 aa, Artificial Sequence
  Description of Artificial Sequence: Synthetic peptide
CGLLAEIEELLEEGLENLIDWWNE

SEQ ID NO: 1400 - protein, 24 aa, Artificial Sequence
  Description of Artificial Sequence: Synthetic peptide
CGLLEEIEELLEEGLENLIDWWNE

SEQ ID NO: 1401 - protein, 24 aa, Artificial Sequence
  Description of Artificial Sequence: Synthetic peptide
CGLLGEIEELLEEGLENLIDWWNS

SEQ ID NO: 1402 - protein, 24 aa, Artificial Sequence
  Description of Artificial Sequence: Synthetic peptide
CGLLAEIEELLEEGLENLIDWWNS

SEQ ID NO: 1403 - protein, 24 aa, Artificial Sequence
  Description of Artificial Sequence: Synthetic peptide
CGLLEEIEELLEEGLENLIDWWNS

SEQ ID NO: 1404 - protein, 24 aa, Artificial Sequence
  Description of Artificial Sequence: Synthetic peptide
CGLFAELEELLEEGLENLLEWWNG

SEQ ID NO: 1405 - protein, 24 aa, Artificial Sequence
  Description of Artificial Sequence: Synthetic peptide
CGLFEELEELLEEGLENLLEWWNG

SEQ ID NO: 1406 - protein, 24 aa, Artificial Sequence
  Description of Artificial Sequence: Synthetic peptide
CGLFGELEELLEEGLENLLEWWNE

SEQ ID NO: 1407 - protein, 24 aa, Artificial Sequence
  Description of Artificial Sequence: Synthetic peptide
CGLFAELEELLEEGLENLLEWWNE

SEQ ID NO: 1408 - protein, 24 aa, Artificial Sequence
  Description of Artificial Sequence: Synthetic peptide
CGLFEELEELLEEGLENLLEWWNE

SEQ ID NO: 1409 - protein, 24 aa, Artificial Sequence
  Description of Artificial Sequence: Synthetic peptide
CGLLGELEELLEEGLENLLEWWNG

SEQ ID NO: 1410 - protein, 24 aa, Artificial Sequence
  Description of Artificial Sequence: Synthetic peptide
CGLLGELEELLEEGLENLLEWWNE

SEQ ID NO: 1411 - protein, 24 aa, Artificial Sequence
  Description of Artificial Sequence: Synthetic peptide
CGILGEIEELLEEGLENLIDWWNG

SEQ ID NO: 1412 - protein, 24 aa, Artificial Sequence
  Description of Artificial Sequence: Synthetic peptide
CGILGEIEELLEEGLENLIDWWNE

SEQ ID NO: 1413 - protein, 24 aa, Artificial Sequence
  Description of Artificial Sequence: Synthetic peptide
CGILGEIEELLEEGLENLIDWWNS

SEQ ID NO: 1414 - protein, 24 aa, Artificial Sequence
  Description of Artificial Sequence: Synthetic peptide
CGILAEIEELLEEGLENLIDWWNG

SEQ ID NO: 1415 - protein, 24 aa, Artificial Sequence
  Description of Artificial Sequence: Synthetic peptide
CGILEEIEELLEEGLENLIDWWNG

SEQ ID NO: 1416 - protein, 15 aa, Artificial Sequence
  Description of Artificial Sequence: Synthetic peptide
CIFGAIAELLKNIFK

SEQ ID NO: 1417 - protein, 15 aa, Artificial Sequence
  Description of Artificial Sequence: Synthetic peptide
CIFGAIAELLENIFK

SEQ ID NO: 1418 - protein, 15 aa, Artificial Sequence
  Description of Artificial Sequence: Synthetic peptide
CIFGAIAGLLENIFK

SEQ ID NO: 1419 - protein, 14 aa, Artificial Sequence
  Description of Artificial Sequence: Synthetic peptide
CFLEELWGLLEHLL

SEQ ID NO: 1420 - protein, 24 aa, Artificial Sequence
  Description of Artificial Sequence: Synthetic peptide
CGILAEIEELLEEGLENLIDWWNQ

SEQ ID NO: 1421 - protein, 24 aa, Artificial Sequence
  Description of Artificial Sequence: Synthetic peptide
CGILAEIEELLEEGLENLIDWWNE

SEQ ID NO: 1422 - protein, 24 aa, Artificial Sequence
  Description of Artificial Sequence: Synthetic peptide
CGLFAEIEELLEEGLENLIDWWNQ

SEQ ID NO: 1423 - protein, 24 aa, Artificial Sequence
  Description of Artificial Sequence: Synthetic peptide
CGLFAEIEELLEEGLENLIDWWNE

SEQ ID NO: 1424 - protein, 24 aa, Artificial Sequence
  Description of Artificial Sequence: Synthetic peptide
CGLFGELEELLEEGLENLLEWWNQ

SEQ ID NO: 1425 - protein, 24 aa, Artificial Sequence
  Description of Artificial Sequence: Synthetic peptide
  MOD_RES (17)..(17): Cit
CGLFAEIAELLEEGLEXLIDWWNE

SEQ ID NO: 1426 - protein, 24 aa, Artificial Sequence
  Description of Artificial Sequence: Synthetic peptide
CGILAEIEELLEEGLENLLEWWNG

SEQ ID NO: 1427 - protein, 24 aa, Artificial Sequence
  Description of Artificial Sequence: Synthetic peptide
CGILEEIEELLEEGLENLIDWWNE

SEQ ID NO: 1428 - protein, 24 aa, Artificial Sequence
  Description of Artificial Sequence: Synthetic peptide
CGILEEIEELLEEGLENLIDWWNQ

SEQ ID NO: 1429 - protein, 24 aa, Artificial Sequence
  Description of Artificial Sequence: Synthetic peptide
CGLFGEIEELIWEGLENLIDWWNG

SEQ ID NO: 1430 - protein, 24 aa, Artificial Sequence
  Description of Artificial Sequence: Synthetic peptide
CGLFGEIAELIWEGLENLIDWWNG

SEQ ID NO: 1431 - protein, 24 aa, Artificial Sequence
  Description of Artificial Sequence: Synthetic peptide
CGLFEEIAELIEEGLENLIDWWNG

SEQ ID NO: 1432 - protein, 24 aa, Artificial Sequence
  Description of Artificial Sequence: Synthetic peptide
CGLFEEIAELIWEGLENLIDWWNG

SEQ ID NO: 1433 - protein, 24 aa, Artificial Sequence
  Description of Artificial Sequence: Synthetic peptide
CELFEEIAELIWEGLENLIDWWNG

SEQ ID NO: 1434 - protein, 24 aa, Artificial Sequence
  Description of Artificial Sequence: Synthetic peptide
CELFEEIAELLWEGLENLIDWWNG

SEQ ID NO: 1435 - protein, 24 aa, Artificial Sequence
  Description of Artificial Sequence: Synthetic peptide
CGLFEEIAELLWEGLENLIDWWNG

SEQ ID NO: 1436 - protein, 24 aa, Artificial Sequence
  Description of Artificial Sequence: Synthetic peptide
CGLFEELAELLWEGLENLIDWWNG

SEQ ID NO: 1437 - protein, 24 aa, Artificial Sequence
  Description of Artificial Sequence: Synthetic peptide
CELFEELAELLWEGLENLIDWWNG

SEQ ID NO: 1438 - protein, 24 aa, Artificial Sequence
  Description of Artificial Sequence: Synthetic peptide
CELFEELAELLWEGLENLIDWWNS

SEQ ID NO: 1439 - protein, 24 aa, Artificial Sequence
  Description of Artificial Sequence: Synthetic peptide
CGLFEELAELLWEGLENLIDWWNS

SEQ ID NO: 1440 - protein, 24 aa, Artificial Sequence
  Description of Artificial Sequence: Synthetic peptide
CGIFEELAELLWEGLENLIDWWNG

SEQ ID NO: 1441 - protein, 24 aa, Artificial Sequence
  Description of Artificial Sequence: Synthetic peptide
CGIFEELAELLWEGLENLIDWWNS

SEQ ID NO: 1442 - protein, 24 aa, Artificial Sequence
  Description of Artificial Sequence: Synthetic peptide
CGLFEELEELLEELLENLIDWWNS

SEQ ID NO: 1443 - protein, 24 aa, Artificial Sequence
  Description of Artificial Sequence: Synthetic peptide
CELFEELEELLEELLENLIDWWNS

SEQ ID NO: 1444 - protein, 24 aa, Artificial Sequence
  Description of Artificial Sequence: Synthetic peptide
CELFEELEELLEELLELLIDWWNS

SEQ ID NO: 1445 - protein, 24 aa, Artificial Sequence
  Description of Artificial Sequence: Synthetic peptide
CEFLEELEELLEELLENLIDWWNS

SEQ ID NO: 1446 - protein, 24 aa, Artificial Sequence
  Description of Artificial Sequence: Synthetic peptide
CELFEELEELLEHLLENLIDWWNS

SEQ ID NO: 1447 - protein, 24 aa, Artificial Sequence
  Description of Artificial Sequence: Synthetic peptide
CELFEELEELLHELLENLIDWWNS

SEQ ID NO: 1448 - protein, 24 aa, Artificial Sequence
  Description of Artificial Sequence: Synthetic peptide
CGLFGELEELLWEGLENLIDWWNG

SEQ ID NO: 1449 - protein, 24 aa, Artificial Sequence
  Description of Artificial Sequence: Synthetic peptide
CGLFGELEELLWEGLHNLIDWWNG

SEQ ID NO: 1450 - protein, 24 aa, Artificial Sequence
  Description of Artificial Sequence: Synthetic peptide
CGLFGELWELLEHGLENLIDWWNG

SEQ ID NO: 1451 - protein, 24 aa, Artificial Sequence
  Description of Artificial Sequence: Synthetic peptide
  MOD_RES (4)..(4): (2R)-2-aminooct-7-enoic acid (R6H)
  MOD_RES (11)..(11): (2S)-2-aminonon-8-enoic acid (S7H)
CGLXGELEELXEEGLENLIDWWNG

SEQ ID NO: 1452 - protein, 24 aa, Artificial Sequence
  Description of Artificial Sequence: Synthetic peptide
CGLFEAIEGFIENGWEGMIDGWNG

SEQ ID NO: 1453 - protein, 24 aa, Artificial Sequence
  Description of Artificial Sequence: Synthetic peptide
CGLFEAIEGFIENGWEGMIDWWNG

SEQ ID NO: 1454 - protein, 24 aa, Artificial Sequence
  Description of Artificial Sequence: Synthetic peptide
CGLFGAIEGFIENGWEGMIDWWNG

SEQ ID NO: 1455 - protein, 24 aa, Artificial Sequence
  Description of Artificial Sequence: Synthetic peptide
CGLFAEIEELLEEGLENLLEWWNG

SEQ ID NO: 1456 - protein, 24 aa, Artificial Sequence
  Description of Artificial Sequence: Synthetic peptide
CGLFAELEELLEEGLENLIDWWNG

SEQ ID NO: 1457 - protein, 24 aa, Artificial Sequence
  Description of Artificial Sequence: Synthetic peptide
CGIFAEIEELLEEGLENLIDWWNG

SEQ ID NO: 1458 - protein, 25 aa, Artificial Sequence
  Description of Artificial Sequence: Synthetic peptide
CGLFAEIEELLEEGLENLIDWWNGF

SEQ ID NO: 1459 - protein, 24 aa, Artificial Sequence
  Description of Artificial Sequence: Synthetic peptide
CGLFAEIEELLEEGLENLIDWWNA

SEQ ID NO: 1460 - protein, 24 aa, Artificial Sequence
  Description of Artificial Sequence: Synthetic peptide
CGLFAEIEELLEEGLENLIDWWNS

SEQ ID NO: 1461 - protein, 24 aa, Artificial Sequence
  Description of Artificial Sequence: Synthetic peptide
  MOD_RES (24)..(24): Cit
CGLFAEIEELLEEGLENLIDWWNX

SEQ ID NO: 1462 - protein, 24 aa, Artificial Sequence
  Description of Artificial Sequence: Synthetic peptide
CGLFGEIAGLLEEGLHNLIDWWNG

SEQ ID NO: 1463 - protein, 24 aa, Artificial Sequence
  Description of Artificial Sequence: Synthetic peptide
CGLFGEIAGLLEQGLHNLIDWWNG

SEQ ID NO: 1464 - protein, 24 aa, Artificial Sequence
  Description of Artificial Sequence: Synthetic peptide
CGLFGEIAGLLESGLHNLIDWWNG

SEQ ID NO: 1465 - protein, 24 aa, Artificial Sequence
  Description of Artificial Sequence: Synthetic peptide
CGLFAEIAGLLEQGLHNLIDWWNG

SEQ ID NO: 1466 - protein, 24 aa, Artificial Sequence
  Description of Artificial Sequence: Synthetic peptide
CGLFAEIAGLLEEGLHNLIDWWNG

SEQ ID NO: 1467 - protein, 24 aa, Artificial Sequence
  Description of Artificial Sequence: Synthetic peptide
CGLFAEIAGLLESGLHNLIDWWNG

SEQ ID NO: 1468 - protein, 24 aa, Artificial Sequence
  Description of Artificial Sequence: Synthetic peptide
CGIFEAIAGLLEQGLHNLIDWWNG

SEQ ID NO: 1469 - protein, 24 aa, Artificial Sequence
  Description of Artificial Sequence: Synthetic peptide
CGLFGAIAELLEEGLHNLIDWWNG

SEQ ID NO: 1470 - protein, 24 aa, Artificial Sequence
  Description of Artificial Sequence: Synthetic peptide
CGLFAAIAELLEEGLHNLIDWWNG

SEQ ID NO: 1471 - protein, 24 aa, Artificial Sequence
  Description of Artificial Sequence: Synthetic peptide
CGIFEAIAGLLKNIFKNLIDWWNG

SEQ ID NO: 1472 - protein, 24 aa, Artificial Sequence
  Description of Artificial Sequence: Synthetic peptide
CGIFGAIWELLEQGLHNLIDWWNG

SEQ ID NO: 1473 - protein, 24 aa, Artificial Sequence
  Description of Artificial Sequence: Synthetic peptide
CGLFAELAGLLEQGLHNLIDWWNG

SEQ ID NO: 1474 - protein, 24 aa, Artificial Sequence
  Description of Artificial Sequence: Synthetic peptide
CGILAELAGLLEQGLHNLIDWWNG

SEQ ID NO: 1475 - protein, 15 aa, Artificial Sequence
  Description of Artificial Sequence: Synthetic peptide
CGLFGEIEELLEHLL

SEQ ID NO: 1476 - protein, 15 aa, Artificial Sequence
  Description of Artificial Sequence: Synthetic peptide
CGLFGEIEELLEELL

SEQ ID NO: 1477 - protein, 15 aa, Artificial Sequence
  Description of Artificial Sequence: Synthetic peptide
CGLFGEIEELLEEGL

SEQ ID NO: 1478 - protein, 15 aa, Artificial Sequence
  Description of Artificial Sequence: Synthetic peptide
CGLFGEIEELLEHGL

SEQ ID NO: 1479 - protein, 15 aa, Artificial Sequence
  Description of Artificial Sequence: Synthetic peptide
CGLFHEIEELLEHLL

SEQ ID NO: 1480 - protein, 15 aa, Artificial Sequence
  Description of Artificial Sequence: Synthetic peptide
CFLGALWKALSELLE

SEQ ID NO: 1481 - protein, 15 aa, Artificial Sequence
  Description of Artificial Sequence: Synthetic peptide
CGLFGEIWELLEEGL

SEQ ID NO: 1482 - protein, 16 aa, Artificial Sequence
  Description of Artificial Sequence: Synthetic peptide
CGLFGEIWELLEEGLI

SEQ ID NO: 1483 - protein, 15 aa, Artificial Sequence
  Description of Artificial Sequence: Synthetic peptide
CGLFGEIWELLEELL

SEQ ID NO: 1484 - protein, 16 aa, Artificial Sequence
  Description of Artificial Sequence: Synthetic peptide
CGLFEEIEELLEELLE

SEQ ID NO: 1485 - protein, 34 aa, Artificial Sequence
  Description of Artificial Sequence: Synthetic polypeptide
CGLFELIEGFIEWGWEGMIDGWYGYGRKKRRQRR

SEQ ID NO: 1486 - protein, 35 aa, Artificial Sequence; identical to SEQ ID NO: 87
  Description of Artificial Sequence: Synthetic polypeptide

SEQ ID NO: 1487 - protein, 16 aa, Artificial Sequence
  Description of Artificial Sequence: Synthetic peptide
CEALFGKINAIFIGKL

SEQ ID NO: 1488 - protein, 24 aa, Artificial Sequence
  Description of Artificial Sequence: Synthetic peptide
CEENWIGLFGGGNIWEEEEILDLL

SEQ ID NO: 1489 - protein, 14 aa, Artificial Sequence
  Description of Artificial Sequence: Synthetic peptide
CLELWLEHLFLELE

SEQ ID NO: 1490 - protein, 34 aa, Artificial Sequence
  Description of Artificial Sequence: Synthetic polypeptide
CGNFEEIEGFIENGWEGLIDGWYGYGRKKRRQRR

SEQ ID NO: 1491 - protein, 34 aa, Artificial Sequence
  Description of Artificial Sequence: Synthetic polypeptide
CRGKWYMGFGEIKRQGEGRRYGLFEDWIAENRGI

SEQ ID NO: 1492 - protein, 33 aa, Artificial Sequence
  Description of Artificial Sequence: Synthetic polypeptide
GLFEAIEGFIENGWEGLAELAEALEALAAGGSC

SEQ ID NO: 1493 - protein, 35 aa, Artificial Sequence; identical to SEQ ID NO: 91
  Description of Artificial Sequence: Synthetic polypeptide

SEQ ID NO: 1494 - protein, 24 aa, Artificial Sequence
  Description of Artificial Sequence: Synthetic peptide
CGFFGEIAGLLENGLHNLIDWWNG

SEQ ID NO: 1495 - protein, 24 aa, Artificial Sequence
  Description of Artificial Sequence: Synthetic peptide
CGFFGEIAALLENGLENLIDWWNG

SEQ ID NO: 1496 - protein, 24 aa, Artificial Sequence
  Description of Artificial Sequence: Synthetic peptide
CGFFGEIAEFIHSGLKNLIDWWNG

SEQ ID NO: 1497 - protein, 24 aa, Artificial Sequence
  Description of Artificial Sequence: Synthetic peptide
CGFFGEIAGLLKNGLKNLIDWWNG

SEQ ID NO: 1498 - protein, 24 aa, Artificial Sequence
  Description of Artificial Sequence: Synthetic peptide
CGFFGEIAGFIKNGLKNLIDWWNG

SEQ ID NO: 1499 - protein, 24 aa, Artificial Sequence
  Description of Artificial Sequence: Synthetic peptide
CGFFGEIAEFIHSILKNLIDWWNG

SEQ ID NO: 1500 - protein, 24 aa, Artificial Sequence
  Description of Artificial Sequence: Synthetic peptide
CGFFGEIAGLLKNILKNLIDWWNG

SEQ ID NO: 1501 - protein, 24 aa, Artificial Sequence
  Description of Artificial Sequence: Synthetic peptide
CGFFGEIAGFIKNILKNLIDWWNG

SEQ ID NO: 1502 - protein, 14 aa, Artificial Sequence
  Description of Artificial Sequence: Synthetic peptide
CFLGALFHALSELL

SEQ ID NO: 1503 - protein, 14 aa, Artificial Sequence
  Description of Artificial Sequence: Synthetic peptide
CFLGALWHALSELL

SEQ ID NO: 1504 - protein, 14 aa, Artificial Sequence
  Description of Artificial Sequence: Synthetic peptide
CFLGALWHALSHLL

SEQ ID NO: 1505 - protein, 14 aa, Artificial Sequence
  Description of Artificial Sequence: Synthetic peptide
CFLGALWELLSHLL

SEQ ID NO: 1506 - protein, 14 aa, Artificial Sequence
  Description of Artificial Sequence: Synthetic peptide
CFLGALWKALSHLL

SEQ ID NO: 1507 - protein, 14 aa, Artificial Sequence
  Description of Artificial Sequence: Synthetic peptide
CFLGALWHALSKLL

SEQ ID NO: 1508 - protein, 14 aa, Artificial Sequence
  Description of Artificial Sequence: Synthetic peptide
CFLGALFHLLSHLL

SEQ ID NO: 1509 - protein, 14 aa, Artificial Sequence
  Description of Artificial Sequence: Synthetic peptide
CFLGALFHLLSELL

SEQ ID NO: 1510 - protein, 14 aa, Artificial Sequence
  Description of Artificial Sequence: Synthetic peptide
CFLGALWHLLSHLL

SEQ ID NO: 1511 - protein, 14 aa, Artificial Sequence
  Description of Artificial Sequence: Synthetic peptide
CFLGALWHLLSELL

SEQ ID NO: 1512 - protein, 15 aa, Artificial Sequence
  Description of Artificial Sequence: Synthetic peptide
CFLGALFHALSHLLE

SEQ ID NO: 1513 - protein, 15 aa, Artificial Sequence
  Description of Artificial Sequence: Synthetic peptide
CFLGALFHLLSHLLE

SEQ ID NO: 1514 - protein, 16 aa, Artificial Sequence
  Description of Artificial Sequence: Synthetic peptide
CGLFGALFHALSHLLE

SEQ ID NO: 1515 - protein, 14 aa, Artificial Sequence
  Description of Artificial Sequence: Synthetic peptide
CFLGALWKALSHLL

SEQ ID NO: 1516 - protein, 24 aa, Artificial Sequence
  Description of Artificial Sequence: Synthetic peptide
CGLFAEIEELLEEGLENLIDWWNG

SEQ ID NO: 1517 - protein, 24 aa, Artificial Sequence
  Description of Artificial Sequence: Synthetic peptide
  MOD_RES (17)..(17): Cit
CGLFGEIEELIEEGLEXLIDWWNG

SEQ ID NO: 1518 - protein, 24 aa, Artificial Sequence
  Description of Artificial Sequence: Synthetic peptide
CGLFGEIEELIEEGLENLIDWWNE

SEQ ID NO: 1519 - protein, 15 aa, Artificial Sequence
  Description of Artificial Sequence: Synthetic peptide
CFFGAIWEFIHSILK

SEQ ID NO: 1520 - protein, 19 aa, Artificial Sequence
  Description of Artificial Sequence: Synthetic peptide
CIFGAIAGFIKNIWEGLIK

SEQ ID NO: 1521 - protein, 16 aa, Artificial Sequence
  Description of Artificial Sequence: Synthetic peptide
CGIFEAIAGLLKNIFK

SEQ ID NO: 1522 - protein, 17 aa, Artificial Sequence
  Description of Artificial Sequence: Synthetic peptide
CGIFEAIAGLLKNIFKK

SEQ ID NO: 1523 - protein, 14 aa, Artificial Sequence
  Description of Artificial Sequence: Synthetic peptide
CFLGALFHALSHLL

SEQ ID NO: 1524 - protein, 20 aa, Artificial Sequence
  Description of Artificial Sequence: Synthetic peptide
CIFGAIAGFIKNILKGLIDG

SEQ ID NO: 1525 - protein, 18 aa, Artificial Sequence
  Description of Artificial Sequence: Synthetic peptide
CIFGAIAGFIKNILKGLK

SEQ ID NO: 1526 - protein, 18 aa, Artificial Sequence
  Description of Artificial Sequence: Synthetic peptide
CIFGAIAGFIKNILKGLK

SEQ ID NO: 1527 - protein, 24 aa, Artificial Sequence
  Description of Artificial Sequence: Synthetic peptide
CGLFGEIEELIEEGLENLIDWWNG

SEQ ID NO: 1528 - protein, 23 aa, Artificial Sequence
  Description of Artificial Sequence: Synthetic peptide
CFLGALWKALSELLKNLIDWWNG

SEQ ID NO: 1529 - protein, 24 aa, Artificial Sequence
  Description of Artificial Sequence: Synthetic peptide
CGFLGALWKALSELLKNLIDWWNG

SEQ ID NO: 1530 - protein, 23 aa, Artificial Sequence
  Description of Artificial Sequence: Synthetic peptide
CFLGALFHALSHLLENLIDWWNG

SEQ ID NO: 1531 - protein, 24 aa, Artificial Sequence
  Description of Artificial Sequence: Synthetic peptide
CGFLGALFHALSHLLENLIDWWNG

SEQ ID NO: 1532 - protein, 24 aa, Artificial Sequence
  Description of Artificial Sequence: Synthetic peptide
CGLFGELEGFIENGLKNLIDWWNG

SEQ ID NO: 1533 - protein, 24 aa, Artificial Sequence
  Description of Artificial Sequence: Synthetic peptide
CGLFGELEGLLWHGLKNLIDWWNG

SEQ ID NO: 1534 - protein, 24 aa, Artificial Sequence
  Description of Artificial Sequence: Synthetic peptide
CGLFGELAELLWHGLKNLIDWWNG

SEQ ID NO: 1535 - protein, 24 aa, Artificial Sequence
  Description of Artificial Sequence: Synthetic peptide
CGLFGELAELLWQGLKNLIDWWNG

SEQ ID NO: 1536 - protein, 24 aa, Artificial Sequence
  Description of Artificial Sequence: Synthetic peptide
CGLFGELWELLWHGLKNLIDWWNG

SEQ ID NO: 1537 - protein, 24 aa, Artificial Sequence
  Description of Artificial Sequence: Synthetic peptide
CGLFGELWELLWQGLKNLIDWWNG

SEQ ID NO: 1538 - protein, 24 aa, Artificial Sequence
  Description of Artificial Sequence: Synthetic peptide
CGLFEELAGLLWHGLKNLIDWWNG

SEQ ID NO: 1539 - protein, 24 aa, Artificial Sequence
  Description of Artificial Sequence: Synthetic peptide
CGLFEELWGLLWHGLKNLIDWWNG

SEQ ID NO: 1540 - protein, 24 aa, Artificial Sequence
  Description of Artificial Sequence: Synthetic peptide
CGLFEELAGLLWQGLKNLIDWWNG

SEQ ID NO: 1541 - protein, 24 aa, Artificial Sequence
  Description of Artificial Sequence: Synthetic peptide
CGLFEELWGLLWQGLKNLIDWWNG

SEQ ID NO: 1542 - protein, 24 aa, Artificial Sequence
  Description of Artificial Sequence: Synthetic peptide
CGLFGELAELLWHGLKNLIDWWNK

SEQ ID NO: 1543 - protein, 24 aa, Artificial Sequence
  Description of Artificial Sequence: Synthetic peptide
CGLFEELAELLWHGLKNLIDWWNK

SEQ ID NO: 1544 - protein, 24 aa, Artificial Sequence
  Description of Artificial Sequence: Synthetic peptide
CGLFGELAELLWHGLKNLIDWWNH

SEQ ID NO: 1545 - protein, 24 aa, Artificial Sequence
  Description of Artificial Sequence: Synthetic peptide
CGLFEELAELLWHGLKNLIDWWNH

SEQ ID NO: 1546 - protein, 24 aa, Artificial Sequence
  Description of Artificial Sequence: Synthetic peptide
CGLFAELWGLLWQGLKNLIDWWNG

SEQ ID NO: 1547 - protein, 24 aa, Artificial Sequence
  Description of Artificial Sequence: Synthetic peptide
CGLFAELWGLLWHGLKNLIDWWNG

SEQ ID NO: 1548 - protein, 24 aa, Artificial Sequence
  Description of Artificial Sequence: Synthetic peptide
CGLFAELWGLLWHGLHNLLDWWNG

SEQ ID NO: 1549 - protein, 24 aa, Artificial Sequence
  Description of Artificial Sequence: Synthetic peptide
CGLFAELAELLWEGLKNLIDWWNG

SEQ ID NO: 1550 - protein, 24 aa, Artificial Sequence
  Description of Artificial Sequence: Synthetic peptide
CGLFAELAELLWHGLKNLIDWWNG

SEQ ID NO: 1551 - protein, 23 aa, Artificial Sequence
  Description of Artificial Sequence: Synthetic peptide
CGLFAELELLWQGLKNLIDWWNG

SEQ ID NO: 1552 - protein, 24 aa, Artificial Sequence
  Description of Artificial Sequence: Synthetic peptide
CELFGELAGLLWHGLKNLIDWWNG

SEQ ID NO: 1553 - protein, 14 aa, Artificial Sequence
  Description of Artificial Sequence: Synthetic peptide
  MOD_RES (9)..(9): Aib
CLFEALWEXLEKLF

SEQ ID NO: 1554 - protein, 14 aa, Artificial Sequence
  Description of Artificial Sequence: Synthetic peptide
CFLEALWELLEHLL

SEQ ID NO: 1555 - protein, 14 aa, Artificial Sequence
  Description of Artificial Sequence: Synthetic peptide
CFLEALWKALEKLL

SEQ ID NO: 1556 - protein, 24 aa, Artificial Sequence
  Description of Artificial Sequence: Synthetic peptide
  MOD_RES (5)..(5): Aib
CGLFXEIAGLLEEGLHNLIDWWNG

SEQ ID NO: 1557 - protein, 24 aa, Artificial Sequence
  Description of Artificial Sequence: Synthetic peptide
  MOD_RES (8)..(8): Aib
CGLFGEIXGLLEEGLHNLIDWWNG

SEQ ID NO: 1558 - protein, 24 aa, Artificial Sequence
  Description of Artificial Sequence: Synthetic peptide
  MOD_RES (14)..(14): Aib
CGFFGEIAGLLEEXLHNLIDWWNG

SEQ ID NO: 1559 - protein, 24 aa, Artificial Sequence
  Description of Artificial Sequence: Synthetic peptide
  MOD_RES (24)..(24): Aib
CGLFGEIAGLLEEGLHNLIDWWNX

SEQ ID NO: 1560 - protein, 24 aa, Artificial Sequence
  Description of Artificial Sequence: Synthetic peptide
  MOD_RES (5)..(5): Aib
  MOD_RES (14)..(14): Aib
CGLFXEIAGLLEEXLHNLIDWWNG

SEQ ID NO: 1561 - protein, 24 aa, Artificial Sequence
  Description of Artificial Sequence: Synthetic peptide
  MOD_RES (8)..(8): Aib
  MOD_RES (14)..(14): Aib
CGFFGEIXGLLEEXLHNLIDWWNG

SEQ ID NO: 1562 - protein, 24 aa, Artificial Sequence
  Description of Artificial Sequence: Synthetic peptide
  MOD_RES (8)..(8): Aib
CGFFGEIXELIWEGLKNLIDWWNG

SEQ ID NO: 1563 - protein, 23 aa, Artificial Sequence
  Description of Artificial Sequence: Synthetic peptide
  MOD_RES (23)..(23): Aib
CGFFGEIAELIWELKNLIDWWNX

SEQ ID NO: 1564 - protein, 24 aa, Artificial Sequence
  Description of Artificial Sequence: Synthetic peptide
  MOD_RES (5)..(5): Aib
  MOD_RES (14)..(14): Aib
CGFFXEIAELIWEXLKNLIDWWNG

SEQ ID NO: 1565 - protein, 14 aa, Artificial Sequence
  Description of Artificial Sequence: Synthetic peptide
CFLGALWKALSHLL

SEQ ID NO: 1566 - protein, 15 aa, Artificial Sequence
  Description of Artificial Sequence: Synthetic peptide
CFLEELWELLEELLE

SEQ ID NO: 1567 - protein, 14 aa, Artificial Sequence
  Description of Artificial Sequence: Synthetic peptide
CLFGALWKALSELL

SEQ ID NO: 1568 - protein, 27 aa, Artificial Sequence
  Description of Artificial Sequence: Synthetic peptide
CGIGAVLKVLTTGLPALISWIKRKRQQ

SEQ ID NO: 1569 - protein, 34 aa, Artificial Sequence; identical to SEQ ID NO: 32
  Description of Artificial Sequence: Synthetic polypeptide

SEQ ID NO: 1570 - protein, 35 aa, Artificial Sequence; identical to SEQ ID NO: 27
  Description of Artificial Sequence: Synthetic polypeptide

SEQ ID NO: 1571 - protein, 14 aa, Artificial Sequence
  Description of Artificial Sequence: Synthetic peptide
CFLGALWKALSHLL

SEQ ID NO: 1572 - protein, 14 aa, Artificial Sequence
  Description of Artificial Sequence: Synthetic peptide
CFLGALWKALSELL

SEQ ID NO: 1573 - protein, 24 aa, Artificial Sequence
  Description of Artificial Sequence: Synthetic peptide
CELFEEIAELLWEGLENLIDWWNG

SEQ ID NO: 1574 - protein, 24 aa, Artificial Sequence
  Description of Artificial Sequence: Synthetic peptide
CGLFGEIAELIWEGLENLIDWWNG

SEQ ID NO: 1575 - protein, 24 aa, Artificial Sequence
  Description of Artificial Sequence: Synthetic peptide
CGLFGEIEELLEEGLENLIDWWNG

SEQ ID NO: 1576 - protein, 24 aa, Artificial Sequence
  Description of Artificial Sequence: Synthetic peptide
CGLFAELAELLWEGLENLIDWWNG

SEQ ID NO: 1577 - protein, 24 aa, Artificial Sequence
  Description of Artificial Sequence: Synthetic peptide
CGLFAELAELLEEGLENLIDWWNG

SEQ ID NO: 1578 - protein, 24 aa, Artificial Sequence
  Description of Artificial Sequence: Synthetic peptide
CGLFAELAELLWEGLENLIDWWNS

SEQ ID NO: 1579 - protein, 24 aa, Artificial Sequence
  Description of Artificial Sequence: Synthetic peptide
CGLFAELAELLEEGLENLIDWWNS

SEQ ID NO: 1580 - protein, 24 aa, Artificial Sequence
  Description of Artificial Sequence: Synthetic peptide
CGLFAELAELLWEGLENLIDWWNQ

SEQ ID NO: 1581 - protein, 24 aa, Artificial Sequence
  Description of Artificial Sequence: Synthetic peptide
CGLFAELAELLEEGLENLIDWWNQ

SEQ ID NO: 1582 - protein, 24 aa, Artificial Sequence
  Description of Artificial Sequence: Synthetic peptide
CGLFAELAELLWEGLENLIDWWNE

SEQ ID NO: 1583 - protein, 24 aa, Artificial Sequence
  Description of Artificial Sequence: Synthetic peptide
CGLFAELAELLEEGLENLIDWWNE

SEQ ID NO: 1584 - protein, 24 aa, Artificial Sequence
  Description of Artificial Sequence: Synthetic peptide
CELFEELAELLWEGLENLIDWWNQ

SEQ ID NO: 1585 - protein, 24 aa, Artificial Sequence
  Description of Artificial Sequence: Synthetic peptide
CELFEELAELLWEGLENLIDWWNE

SEQ ID NO: 1586 - protein, 24 aa, Artificial Sequence
  Description of Artificial Sequence: Synthetic peptide
CELFEELAELLEEGLENLIDWWNG

SEQ ID NO: 1587 - protein, 24 aa, Artificial Sequence
  Description of Artificial Sequence: Synthetic peptide
CELFAELAELLWEGLENLIDWWNG

SEQ ID NO: 1588 - protein, 24 aa, Artificial Sequence
  Description of Artificial Sequence: Synthetic peptide
CELFAELAELLEEGLENLIDWWNG

SEQ ID NO: 1589 - protein, 24 aa, Artificial Sequence
  Description of Artificial Sequence: Synthetic peptide
CELFAELAELLWEGLENLIDWWNS

SEQ ID NO: 1590 - protein, 24 aa, Artificial Sequence
  Description of Artificial Sequence: Synthetic peptide
CELFAELAELLEEGLENLIDWWNS

SEQ ID NO: 1591 - protein, 24 aa, Artificial Sequence
  Description of Artificial Sequence: Synthetic peptide
CELFAELAELLWEGLENLIDWWNQ

SEQ ID NO: 1592 - protein, 24 aa, Artificial Sequence
  Description of Artificial Sequence: Synthetic peptide
CELFAELAELLEEGLENLIDWWNQ

SEQ ID NO: 1593 - protein, 24 aa, Artificial Sequence
  Description of Artificial Sequence: Synthetic peptide
CELFAELAELLWEGLENLIDWWNE

SEQ ID NO: 1594 - protein, 24 aa, Artificial Sequence
  Description of Artificial Sequence: Synthetic peptide
CELFAELAELLEEGLENLIDWWNE

SEQ ID NO: 1595 - protein, 24 aa, Artificial Sequence
  Description of Artificial Sequence: Synthetic peptide
CELFEELAELLWEGLHNLIDWWNG

SEQ ID NO: 1596 - protein, 24 aa, Artificial Sequence
  Description of Artificial Sequence: Synthetic peptide
CELFEELAELLWEGLHNLIDWWNS

SEQ ID NO: 1597 - protein, 24 aa, Artificial Sequence
  Description of Artificial Sequence: Synthetic peptide
CELFEELAELLWEGLHNLIDWWNQ

SEQ ID NO: 1598 - protein, 24 aa, Artificial Sequence
  Description of Artificial Sequence: Synthetic peptide
CELFEELAELLWEGLHNLIDWWNE

SEQ ID NO: 1599 - protein, 24 aa, Artificial Sequence
  Description of Artificial Sequence: Synthetic peptide
CELFGELEGFIENGLENLIDWWNG

SEQ ID NO: 1600 - protein, 24 aa, Artificial Sequence
  Description of Artificial Sequence: Synthetic peptide
CGLFEELEGFIENGLENLIDWWNG

SEQ ID NO: 1601 - protein, 24 aa, Artificial Sequence
  Description of Artificial Sequence: Synthetic peptide
CGLFAELAGFIENGLENLIDWWNG

SEQ ID NO: 1602 - protein, 24 aa, Artificial Sequence
  Description of Artificial Sequence: Synthetic peptide
CGLFAELEGFIENGLENLIDWWNG

SEQ ID NO: 1603 - protein, 24 aa, Artificial Sequence
  Description of Artificial Sequence: Synthetic peptide
CGLFGELAGFIENGLENLIDWWNG

SEQ ID NO: 1604 - protein, 24 aa, Artificial Sequence
  Description of Artificial Sequence: Synthetic peptide
CELFEELEGFIENGLENLIDWWNG

SEQ ID NO: 1605 - protein, 24 aa, Artificial Sequence
  Description of Artificial Sequence: Synthetic peptide
CELFAELAGFIENGLENLIDWWNG

SEQ ID NO: 1606 - protein, 24 aa, Artificial Sequence
  Description of Artificial Sequence: Synthetic peptide
CGLFGELEGFIWNGLENLIDWWNG

SEQ ID NO: 1607 - protein, 24 aa, Artificial Sequence
  Description of Artificial Sequence: Synthetic peptide
CGLFGELEGFIENGLENLIDWWNG

SEQ ID NO: 1608 - protein, 24 aa, Artificial Sequence
  Description of Artificial Sequence: Synthetic peptide
CGLFGELEGFIENGLENLIDWWNQ

SEQ ID NO: 1609 - protein, 24 aa, Artificial Sequence
  Description of Artificial Sequence: Synthetic peptide
CGLFGELEGFIENGLENLIDWWNE

SEQ ID NO: 1610 - protein, 24 aa, Artificial Sequence
  Description of Artificial Sequence: Synthetic peptide
CELFEELEGFIENGLENLIDWWNE

SEQ ID NO: 1611 - protein, 24 aa, Artificial Sequence
  Description of Artificial Sequence: Synthetic peptide
CGLLEEIAELLEEGLENLIDWWNS

SEQ ID NO: 1612 - protein, 24 aa, Artificial Sequence
  Description of Artificial Sequence: Synthetic peptide
CGLLEEIEELLWEGLENLIDWWNS

SEQ ID NO: 1613 - protein, 24 aa, Artificial Sequence
  Description of Artificial Sequence: Synthetic peptide
CELLEEIEELLEEGLENLIDWWNS

SEQ ID NO: 1614 - protein, 24 aa, Artificial Sequence
  Description of Artificial Sequence: Synthetic peptide
CGLLEEIAELLWEGLENLIDWWNS

SEQ ID NO: 1615 - protein, 24 aa, Artificial Sequence
  Description of Artificial Sequence: Synthetic peptide
CELLEEIAELLWEGLENLIDWWNS

SEQ ID NO: 1616 - protein, 24 aa, Artificial Sequence
  Description of Artificial Sequence: Synthetic peptide
CELLEEIEELLEEGLENLIDWWNE

SEQ ID NO: 1617 - protein, 24 aa, Artificial Sequence
  Description of Artificial Sequence: Synthetic peptide
CGLLEELEELLEEGLENLIDWWNS

SEQ ID NO: 1618 - protein, 24 aa, Artificial Sequence
  Description of Artificial Sequence: Synthetic peptide
CGLLEELEELLEEGLENLLEWWNS

SEQ ID NO: 1619 - protein, 24 aa, Artificial Sequence
  Description of Artificial Sequence: Synthetic peptide
CGLLEEIAELLEEGLENLIDWWNG

SEQ ID NO: 1620 - protein, 24 aa, Artificial Sequence
  Description of Artificial Sequence: Synthetic peptide
CGLLAEIAELLEEGLENLIDWWNS

SEQ ID NO: 1621 - protein, 24 aa, Artificial Sequence
  Description of Artificial Sequence: Synthetic peptide
CGLLAEIAELLWEGLENLIDWWNS

SEQ ID NO: 1622 - protein, 24 aa, Artificial Sequence
  Description of Artificial Sequence: Synthetic peptide
CGLLEEIEGFIENGLENLIDWWNS

SEQ ID NO: 1623 - protein, 24 aa, Artificial Sequence
  Description of Artificial Sequence: Synthetic peptide
CGLLEEIEGFIENGLENLIDWWNG

SEQ ID NO: 1624 - protein, 24 aa, Artificial Sequence
  Description of Artificial Sequence: Synthetic peptide
  MOD_RES (17)..(17): Cit
CGLLEEIEELLEEGLEXLIDWWNS

SEQ ID NO: 1625 - protein, 24 aa, Artificial Sequence
  Description of Artificial Sequence: Synthetic peptide
CGLLEEIEELLEQGLENLIDWWNS

SEQ ID NO: 1626 - protein, 24 aa, Artificial Sequence
  Description of Artificial Sequence: Synthetic peptide
CGLLAELAELLEEGLENLIDWWNS

SEQ ID NO: 1627 - protein, 24 aa, Artificial Sequence
  Description of Artificial Sequence: Synthetic peptide
CGLLEEIEELLEEGLENLIDWWNA

SEQ ID NO: 1628 - protein, 24 aa, Artificial Sequence
  Description of Artificial Sequence: Synthetic peptide
  MOD_RES (5)..(5): Aib
CGLLXEIEELLEEGLENLIDWWNS

SEQ ID NO: 1629 - protein, 24 aa, Artificial Sequence
  Description of Artificial Sequence: Synthetic peptide
  MOD_RES (24)..(24): Aib
CGLLEEIEELLEEGLENLIDWWNX

SEQ ID NO: 1630 - protein, 24 aa, Artificial Sequence
  Description of Artificial Sequence: Synthetic peptide
  MOD_RES (14)..(14): Aib
CGLLEEIEELLEEXLENLIDWWNG

SEQ ID NO: 1631 - protein, 24 aa, Artificial Sequence
  Description of Artificial Sequence: Synthetic peptide
CGLFGHIHHLIHHGLHNLIDWWNG

SEQ ID NO: 1632 - protein, 24 aa, Artificial Sequence
  Description of Artificial Sequence: Synthetic peptide
CGLFGEIHHLIHHGLHNLIDWWNG

SEQ ID NO: 1633 - protein, 24 aa, Artificial Sequence
  Description of Artificial Sequence: Synthetic peptide
CGLFGEIHHLIHHGLENLIDWWNG

SEQ ID NO: 1634 - protein, 24 aa, Artificial Sequence
  Description of Artificial Sequence: Synthetic peptide
CGLFGEIHELIHHGLENLIDWWNG

SEQ ID NO: 1635 - protein, 24 aa, Artificial Sequence
  Description of Artificial Sequence: Synthetic peptide
CELLEEIEELLEEGLENLIDWWNS

SEQ ID NO: 1636 - protein, 24 aa, Artificial Sequence
  Description of Artificial Sequence: Synthetic peptide
CGLFGELEELIEEGLENLIDWWNG

SEQ ID NO: 1637 - protein, 24 aa, Artificial Sequence
  Description of Artificial Sequence: Synthetic peptide
CGLLAEIEELLWEGLENLIDWWNS

SEQ ID NO: 1638 - protein, 24 aa, Artificial Sequence
  Description of Artificial Sequence: Synthetic peptide
CGLLEEIEELLEEGLENLLEWWNS

SEQ ID NO: 1639 - protein, 24 aa, Artificial Sequence
  Description of Artificial Sequence: Synthetic peptide
  MOD_RES (2)..(2): b-Ala
CALLEEIEELLEEGLENLIDWWNS

SEQ ID NO: 1640 - protein, 24 aa, Artificial Sequence
  Description of Artificial Sequence: Synthetic peptide
CGLLEEIEELLEEGLENLIDLWNS

SEQ ID NO: 1641 - protein, 24 aa, Artificial Sequence
  Description of Artificial Sequence: Synthetic peptide
CGLLEEIEELLEWGLENLIDWWNS

SEQ ID NO: 1642 - protein, 24 aa, Artificial Sequence
  Description of Artificial Sequence: Synthetic peptide
CGLFGEIEELIEEGLENLIDWGNG

SEQ ID NO: 1643 - protein, 24 aa, Artificial Sequence
  Description of Artificial Sequence: Synthetic peptide
CGFFGEIAELIEEGLKNLIDWGNG

SEQ ID NO: 1644 - protein, 24 aa, Artificial Sequence
  Description of Artificial Sequence: Synthetic peptide
CGLFGEIEELIEEGLENLIDWANG

SEQ ID NO: 1645 - protein, 24 aa, Artificial Sequence
  Description of Artificial Sequence: Synthetic peptide
CGLFGEIEELIEEGLENLIDWSNG

SEQ ID NO: 1646 - protein, 24 aa, Artificial Sequence
  Description of Artificial Sequence: Synthetic peptide
  MOD_RES (22)..(22): Aib
CGLFGEIEELIEEGLENLIDWXNG

SEQ ID NO: 1647 - protein, 24 aa, Artificial Sequence
  Description of Artificial Sequence: Synthetic peptide
CGLFGEIEELIEEGLENLIDWPNG

SEQ ID NO: 1648 - protein, 24 aa, Artificial Sequence
  Description of Artificial Sequence: Synthetic peptide
CGLFGEIEELIEEGLENLIDWHNG

SEQ ID NO: 1649 - protein, 24 aa, Artificial Sequence
  Description of Artificial Sequence: Synthetic peptide
CGLFGEIEELIEEGLENLIDWQNG

SEQ ID NO: 1650 - protein, 24 aa, Artificial Sequence
  Description of Artificial Sequence: Synthetic peptide
CGLFGEIEELIEEGLENLIDWENG

SEQ ID NO: 1651 - protein, 24 aa, Artificial Sequence
  Description of Artificial Sequence: Synthetic peptide
CGLFEEIAELIEEGLENLIDWGNG

SEQ ID NO: 1652 - protein, 24 aa, Artificial Sequence
  Description of Artificial Sequence: Synthetic peptide
CELFEELAELLWEGLENLIDWGNS

SEQ ID NO: 1653 - protein, 24 aa, Artificial Sequence
  Description of Artificial Sequence: Synthetic peptide
CGLFGEIAELIWEGLENLIDWGNG

SEQ ID NO: 1654 - protein, 24 aa, Artificial Sequence
  Description of Artificial Sequence: Synthetic peptide
CGLLEEIEELLEEGLENLIDWGNS

SEQ ID NO: 1655 - protein, 24 aa, Artificial Sequence
  Description of Artificial Sequence: Synthetic peptide
CGLFAEIEELLEEGLENLIDWGNG

SEQ ID NO: 1656 - protein, 24 aa, Artificial Sequence
  Description of Artificial Sequence: Synthetic peptide
  MOD_RES (5)..(5): Aib
CGLLXEIEELLEEGLENLIDWWNS

SEQ ID NO: 1657 - protein, 24 aa, Artificial Sequence
  Description of Artificial Sequence: Synthetic peptide
CGLFGEIEELIEEGLENLIDWNNG

SEQ ID NO: 1658 - protein, 24 aa, Artificial Sequence
  Description of Artificial Sequence: Synthetic peptide
CGLFGEIEELIEEGLENLIDWDNG

SEQ ID NO: 1659 - protein, 24 aa, Artificial Sequence
  Description of Artificial Sequence: Synthetic peptide
  MOD_RES (22)..(22): Ornithine
CGLFGEIEELIEEGLENLIDWXNG

SEQ ID NO: 1660 - protein, 24 aa, Artificial Sequence
  Description of Artificial Sequence: Synthetic peptide
CGLFAEIEELLEEGLENLIDWGNG

SEQ ID NO: 1661 - protein, 24 aa, Artificial Sequence
  Description of Artificial Sequence: Synthetic peptide
  MOD_RES (5)..(5): Aib
CGLLXEIEELLEEGLENLIDWGNS

SEQ ID NO: 1662 - protein, 24 aa, Artificial Sequence
  Description of Artificial Sequence: Synthetic peptide
CGLFGEIEELIEEGLENLIDGWNG

SEQ ID NO: 1663 - protein, 24 aa, Artificial Sequence
  Description of Artificial Sequence: Synthetic peptide
CGLFGEIEELIEEGLENLIDLWNG

SEQ ID NO: 1664 - protein, 24 aa, Artificial Sequence
  Description of Artificial Sequence: Synthetic peptide
CGWFGEIEELIEEGLENLIDWWNG

SEQ ID NO: 1665 - protein, 24 aa, Artificial Sequence
  Description of Artificial Sequence: Synthetic peptide
CGLFGEVEELIEEGLENLIDWWNG

SEQ ID NO: 1666 - protein, 24 aa, Artificial Sequence
  Description of Artificial Sequence: Synthetic peptide
CGLFGEIEEVIEEGLENLIDWWNG

SEQ ID NO: 1667 - protein, 24 aa, Artificial Sequence
  Description of Artificial Sequence: Synthetic peptide
CGLFGEIEELVEEGLENLIDWWNG

SEQ ID NO: 1668 - protein, 24 aa, Artificial Sequence
  Description of Artificial Sequence: Synthetic peptide
CGLFGEIEELAEEGLENLIDWWNG

SEQ ID NO: 1669 - protein, 24 aa, Artificial Sequence
  Description of Artificial Sequence: Synthetic peptide
CGLFGEIEELIDEGLENLIDWWNG

SEQ ID NO: 1670 - protein, 24 aa, Artificial Sequence
  Description of Artificial Sequence: Synthetic peptide
CGLFGEIEELIEDGLENLIDWWNG

SEQ ID NO: 1671 - protein, 24 aa, Artificial Sequence
  Description of Artificial Sequence: Synthetic peptide
CGLFGEIEELIEEGLEALIDWWNG

SEQ ID NO: 1672 - protein, 24 aa, Artificial Sequence
  Description of Artificial Sequence: Synthetic peptide
CGLFGEIEELIEEGLENIIDWWNG

SEQ ID NO: 1673 - protein, 24 aa, Artificial Sequence
  Description of Artificial Sequence: Synthetic peptide
  MOD_RES (18)..(18): Nle
CGLFGEIEELIEEGLENLIDWWNG

SEQ ID NO: 1674 - protein, 24 aa, Artificial Sequence
  Description of Artificial Sequence: Synthetic peptide
CGLFGEIEELIEEGLENLIGWWNG

SEQ ID NO: 1675 - protein, 24 aa, Artificial Sequence
  Description of Artificial Sequence: Synthetic peptide
CGLFGEIEELIEEGLENLIDAWNG

SEQ ID NO: 1676 - protein, 24 aa, Artificial Sequence
  Description of Artificial Sequence: Synthetic peptide
CGLLEEIEELLEEGLENLIDWWNE

SEQ ID NO: 1677 - protein, 24 aa, Artificial Sequence
  Description of Artificial Sequence: Synthetic peptide
CELFEELAELLWEGLENLIDWWNE

SEQ ID NO: 1678 - protein, 24 aa, Artificial Sequence
  Description of Artificial Sequence: Synthetic peptide
CGLFGEIEELIEEGLENLIGWWNG

SEQ ID NO: 1679 - protein, 34 aa, Artificial Sequence; identical to SEQ ID NO: 13
  Description of Artificial Sequence: Synthetic polypeptide
  MOD_RES (1)..(34): D-amino acid

SEQ ID NO: 1680 - protein, 24 aa, Artificial Sequence
  Description of Artificial Sequence: Synthetic peptide
  MOD_RES (1)..(24): D-amino acid
CGLFEAIEGFIENGWEGMIDGWYG

SEQ ID NO: 1681 - protein, 34 aa, Artificial Sequence; identical to SEQ ID NO: 60
  Description of Artificial Sequence: Synthetic polypeptide
  MOD_RES (1)..(34): D-amino acid

SEQ ID NO: 1682 - protein, 31 aa, Artificial Sequence; identical to SEQ ID NO: 31
  Description of Artificial Sequence: Synthetic polypeptide
  MOD_RES (1)..(31): D-amino acid

SEQ ID NO: 1683 - protein, 34 aa, Artificial Sequence; identical to SEQ ID NO: 66
  Description of Artificial Sequence: Synthetic polypeptide
  MOD_RES (1)..(34): D-amino acid

SEQ ID NO: 1684 - protein, 24 aa, Artificial Sequence
  Description of Artificial Sequence: Synthetic peptide
  MOD_RES (1)..(24): D-amino acid
CGLFGEIEELIEEGLENLIDWWNE

SEQ ID NO: 1685 - protein, 24 aa, Artificial Sequence
  Description of Artificial Sequence: Synthetic peptide
  MOD_RES (1)..(24): D-amino acid
CGLFGEIEELIEEGLENLIDWWNS

SEQ ID NO: 1686 - protein, 24 aa, Artificial Sequence
  Description of Artificial Sequence: Synthetic peptide
  MOD_RES (1)..(24): D-amino acid
CGLFGEIEELIEEGLENLIDWWNQ

SEQ ID NO: 1687 - protein, 34 aa, Artificial Sequence
  Description of Artificial Sequence: Synthetic polypeptide
CYGRKKRRQRRLIRLWSHLIHIWFQNRRLKWKKK

SEQ ID NO: 1688 - protein, 34 aa, Artificial Sequence
  Description of Artificial Sequence: Synthetic polypeptide
CGLFEAIEEFIENGWEGMIDGWYGYGRKKRRQRR

SEQ ID NO: 1689 - protein, 34 aa, Artificial Sequence
  Description of Artificial Sequence: Synthetic polypeptide
  MOD_RES (1)..(34): D-amino acid
CGLFFAIEGFIENGWEGMIDWWYGYGRKKRRQRR

SEQ ID NO: 1690 - protein, 35 aa, Artificial Sequence; identical to SEQ ID NO: 496
  Description of Artificial Sequence: Synthetic polypeptide
  MOD_RES (1)..(35): D-amino acid

SEQ ID NO: 1691 - protein, 34 aa, Artificial Sequence
  Description of Artificial Sequence: Synthetic polypeptide
  MOD_RES (1)..(34): D-amino acid
GLFELIEGFIENGWEGMIDGWYGYGRKKRRQRRC

SEQ ID NO: 1692 - protein, 15 aa, Artificial Sequence
  Description of Artificial Sequence: Synthetic peptide
  MOD_RES (1)..(15): D-amino acid
CFFGAIWEFIKSILK

SEQ ID NO: 1693 - protein, 31 aa, Artificial Sequence; identical to SEQ ID NO: 621
  Description of Artificial Sequence: Synthetic polypeptide
  MOD_RES (1)..(31): D-amino acid

SEQ ID NO: 1694 - protein, 20 aa, Artificial Sequence
  Description of Artificial Sequence: Synthetic peptide
  MOD_RES (1)..(20): D-amino acid
CIFGAIAGFIKNILKGLIDG

SEQ ID NO: 1695 - protein, 35 aa, Artificial Sequence; identical to SEQ ID NO: 27
  Description of Artificial Sequence: Synthetic polypeptide
  MOD_RES (1)..(35): D-amino acid

SEQ ID NO: 1696 - protein, 14 aa, Artificial Sequence
  Description of Artificial Sequence: Synthetic peptide
  MOD_RES (1)..(14): D-amino acid
FFGAIWEFIKSILC

SEQ ID NO: 1697 - RNA, 21 nt, Artificial Sequence
  Description of Artificial Sequence: Synthetic oligonucleotide
cuguuggauugauucgaaauu

SEQ ID NO: 1698 - RNA, 21 nt, Artificial Sequence
  Description of Artificial Sequence: Synthetic oligonucleotide
uuucgaaucaauccaacaguu

SEQ ID NO: 1699 - DNA, 21 bp, Artificial Sequence
  Description of Artificial Sequence: Synthetic oligonucleotide
  Description of Combined DNA/RNA Molecule: Synthetic oligonucleotide
cuuuaacaauuccugaaautt

SEQ ID NO: 1700 - RNA, 21 nt, Artificial Sequence
  Description of Artificial Sequence: Synthetic oligonucleotide
auuucaggaauuguuaaaguu

SEQ ID NO: 1701 - RNA, 21 nt, Artificial Sequence
  Description of Artificial Sequence: Synthetic oligonucleotide
cuguuggauugauucgaaauu

SEQ ID NO: 1702 - RNA, 21 nt, Artificial Sequence
  Description of Artificial Sequence: Synthetic oligonucleotide
uuucgaaucaauccaacaguu

SEQ ID NO: 1703 - RNA, 21 nt, Artificial Sequence
  Description of Artificial Sequence: Synthetic oligonucleotide
cuguuggauugauucgaaauu

SEQ ID NO: 1704 - RNA, 21 nt, Artificial Sequence
  Description of Artificial Sequence: Synthetic oligonucleotide
uuucgaaucaauccaacaguu

SEQ ID NO: 1705 - RNA, 21 nt, Artificial Sequence
  Description of Artificial Sequence: Synthetic oligonucleotide
cuguuggauugauucgaaauu

SEQ ID NO: 1706 - RNA, 21 nt, Artificial Sequence
  Description of Artificial Sequence: Synthetic oligonucleotide
uuucgaaucaauccaacaguu

SEQ ID NO: 1707 - RNA, 21 nt, Artificial Sequence
  Description of Artificial Sequence: Synthetic oligonucleotide
cuguuggauugauucgaaauu

SEQ ID NO: 1708 - RNA, 21 nt, Artificial Sequence
  Description of Artificial Sequence: Synthetic oligonucleotide
uuucgaaucaauccaacaguu

SEQ ID NO: 1709 - RNA, 21 nt, Artificial Sequence
  Description of Artificial Sequence: Synthetic oligonucleotide
cuguuggauugauucgaaauu

SEQ ID NO: 1710 - RNA, 21 nt, Artificial Sequence
  Description of Artificial Sequence: Synthetic oligonucleotide
uuucgaaucaauccaacaguu

SEQ ID NO: 1711 - DNA, 22 bp, Artificial Sequence
  Description of Artificial Sequence: Synthetic oligonucleotide
  Description of Combined DNA/RNA Molecule: Synthetic oligonucleotide
tcuguuggauugauucgaaauu

SEQ ID NO: 1712 - RNA, 21 nt, Artificial Sequence
  Description of Artificial Sequence: Synthetic oligonucleotide
uuucgaaucaauccaacaguu

SEQ ID NO: 1713 - RNA, 21 nt, Artificial Sequence
  Description of Artificial Sequence: Synthetic oligonucleotide
cuguuggauugauucgaaauu

SEQ ID NO: 1714 - RNA, 21 nt, Artificial Sequence
  Description of Artificial Sequence: Synthetic oligonucleotide
uuucgaaucaauccaacaguu

SEQ ID NO: 1715 - RNA, 21 nt, Artificial Sequence
  Description of Artificial Sequence: Synthetic oligonucleotide
cuguuggauugauucgaaauu

SEQ ID NO: 1716 - RNA, 21 nt, Artificial Sequence
  Description of Artificial Sequence: Synthetic oligonucleotide
uuucgaaucaauccaacaguu

SEQ ID NO: 1717 - RNA, 21 nt, Artificial Sequence
  Description of Artificial Sequence: Synthetic oligonucleotide
cuguuggauugauucgaaauu

SEQ ID NO: 1718 - RNA, 21 nt, Artificial Sequence
  Description of Artificial Sequence: Synthetic oligonucleotide
uuucgaaucaauccaacaguu

SEQ ID NO: 1719 - RNA, 21 nt, Artificial Sequence
  Description of Artificial Sequence: Synthetic oligonucleotide
cuguuggauugauucgaaauu

SEQ ID NO: 1720 - RNA, 21 nt, Artificial Sequence
  Description of Artificial Sequence: Synthetic oligonucleotide
uuucgaaucaauccaacaguu

SEQ ID NO: 1721 - DNA, 21 bp, Artificial Sequence
  Description of Artificial Sequence: Synthetic oligonucleotide
  Description of Combined DNA/RNA Molecule: Synthetic oligonucleotide
cuuuaacaauuccugaaautt

SEQ ID NO: 1722 - RNA, 21 nt, Artificial Sequence
  Description of Artificial Sequence: Synthetic oligonucleotide
auuucaggaauuguuaaaguu

SEQ ID NO: 1723 - DNA, 21 bp, Artificial Sequence
  Description of Artificial Sequence: Synthetic oligonucleotide
  Description of Combined DNA/RNA Molecule: Synthetic oligonucleotide
cuuuaacaauuccugaaautt

SEQ ID NO: 1724 - RNA, 21 nt, Artificial Sequence
  Description of Artificial Sequence: Synthetic oligonucleotide
auuucaggaauuguuaaaguu

SEQ ID NO: 1725 - DNA, 21 bp, Artificial Sequence
  Description of Artificial Sequence: Synthetic oligonucleotide
  Description of Combined DNA/RNA Molecule: Synthetic oligonucleotide
cuuuaacaauuccugaaautt

SEQ ID NO: 1726 - RNA, 21 nt, Artificial Sequence
  Description of Artificial Sequence: Synthetic oligonucleotide
auuucaggaauuguuaaaguu

SEQ ID NO: 1727 - DNA, 21 bp, Artificial Sequence
  Description of Artificial Sequence: Synthetic oligonucleotide
  Description of Combined DNA/RNA Molecule: Synthetic oligonucleotide
cuuuaacaauuccugaaautt

SEQ ID NO: 1728 - RNA, 21 nt, Artificial Sequence
  Description of Artificial Sequence: Synthetic oligonucleotide
auuucaggaauuguuaaaguu

SEQ ID NO: 1729 - DNA, 21 bp, Artificial Sequence
  Description of Artificial Sequence: Synthetic oligonucleotide
  Description of Combined DNA/RNA Molecule: Synthetic oligonucleotide
cuuuaacaauuccugaaautt

SEQ ID NO: 1730 - RNA, 21 nt, Artificial Sequence
  Description of Artificial Sequence: Synthetic oligonucleotide
auuucaggaauuguuaaaguu

SEQ ID NO: 1731 - DNA, 21 bp, Artificial Sequence
  Description of Artificial Sequence: Synthetic oligonucleotide
  Description of Combined DNA/RNA Molecule: Synthetic oligonucleotide
acaacagacuuuaauguaatt

SEQ ID NO: 1732 - RNA, 21 nt, Artificial Sequence
  Description of Artificial Sequence: Synthetic oligonucleotide
uuacauuaaagucuguuguuu

SEQ ID NO: 1733 - RNA, 21 nt, Artificial Sequence
  Description of Artificial Sequence: Synthetic oligonucleotide
cuguuggauugauucgaaauu

SEQ ID NO: 1734 - RNA, 21 nt, Artificial Sequence
  Description of Artificial Sequence: Synthetic oligonucleotide
uuucgaaucaauccaacaguu

SEQ ID NO: 1735 - RNA, 21 nt, Artificial Sequence
  Description of Artificial Sequence: Synthetic oligonucleotide
cuguuggauugauucgaaauu

SEQ ID NO: 1736 - RNA, 21 nt, Artificial Sequence
  Description of Artificial Sequence: Synthetic oligonucleotide
uuucgaaucaauccaacaguu

SEQ ID NO: 1737 - protein, 24 aa, Artificial Sequence
  Description of Artificial Sequence: Synthetic peptide
  MOD_RES (1)..(24): D-amino acid
CGFLGEIEELIEEGLENLIDWWNS

SEQ ID NO: 1738 - protein, 28 aa, Artificial Sequence
  Description of Artificial Sequence: Synthetic peptide
  MOD_RES (1)..(4): D-amino acid
CGLFCGFLGEIEELIEEGLENLIDWWNS

SEQ ID NO: 1739 - protein, 20 aa, Artificial Sequence
  Description of Artificial Sequence: Synthetic peptide
  MOD_RES (1)..(20): D-amino acid
GEIEELIEEGLENLIDWWNS

What is claimed is:

1. A modular composition comprising:
   1) a single stranded or double stranded oligonucleotide;
   2) one or more tetraGalNAc ligands of Formula (I), (II) or (III), which may be the same or different:

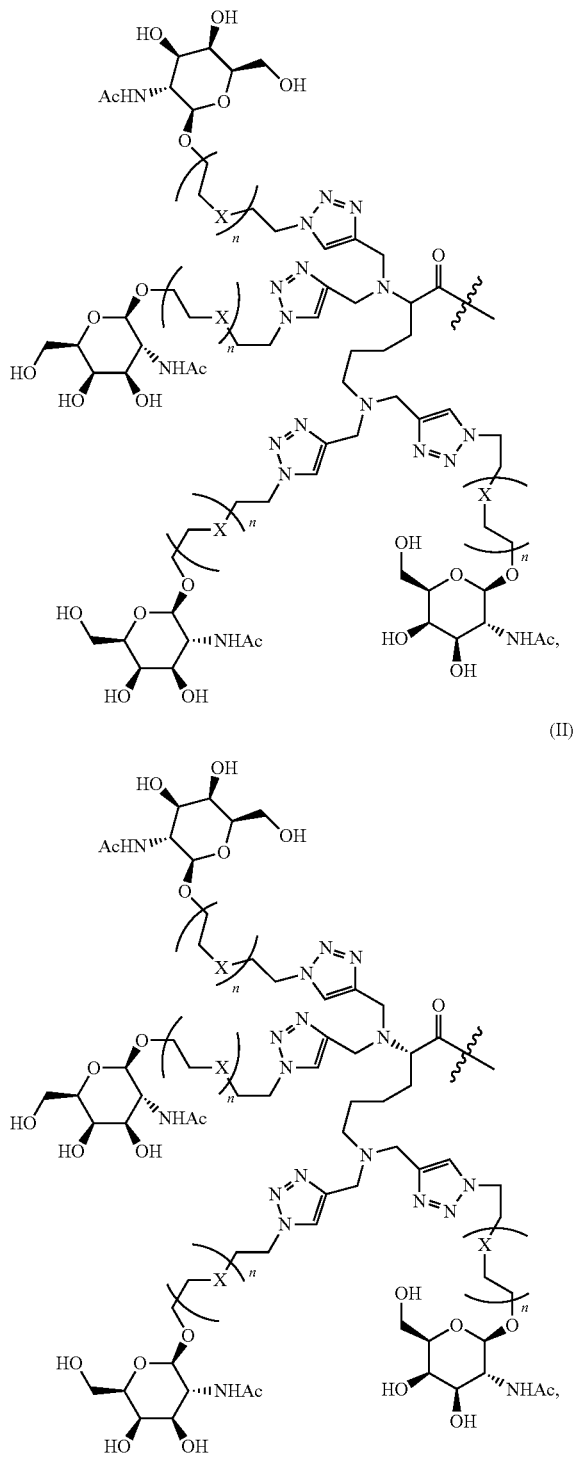

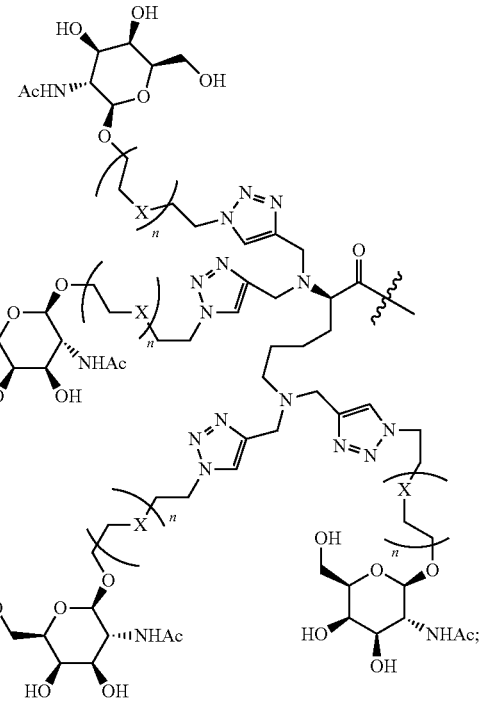

wherein X is —O—, —S—, —CR¹R²— or —NR¹—, wherein R¹ and R² are each independently selected from the group consisting of hydrogen and C1-C6 alkyl; n is 1, 2, 3, or 4; and the bond with "∿∿" indicates the point of attachment;

optionally, 3) one or more linkers, which may be the same or different;

optionally, 4) one or more peptides independently selected from SEQ ID No. 1-474, or the D-amino acid, retro-inverso, and cysteine conjugation point variants thereof, which may be the same or different, wherein the cysteine conjugation point variants thereof refers to variants of the peptides comprising conjugation through existing cysteines or through a cysteine residue added to a N- or C-terminus of the peptides; and optionally, 5) one or more targeting ligands, solubilizing agents, pharmacokinetics enhancing agents, lipids, and/or masking agents.

2. The modular composition of claim 1 comprising:
   1) a single stranded or double stranded oligonucleotide;
   2) 1-8 tetraGalNAc ligands of Formula (II), which may be the same or different, wherein X is —O—, —S—, —CH₂— or NH—; and n is 1, 2, 3, or 4;
   3) 1-24 linkers, which may be the same or different;
   4) 1-8 peptides independently selected from SEQ ID No. 1-474, which may be the same or different; and
   optionally, 5) 1-8 targeting ligands, solubilizing agents, pharmacokinetics enhancing agents, lipids, and/or masking agents.

3. A modular composition comprising:
   1) a single stranded or double stranded siRNA;
   2) 1-8 tetraGalNAc ligands of Formula (I), (II) or (III), which may be the same or different, wherein X is —O—, —S—, —CH₂— or NH—; and n is 1, 2, 3, or 4;

3) 1-24 linkers, which may be the same or different;
4) 1-12 peptides independently selected from SEQ ID No. 1-474, or the D-amino acid, retro-inverso, and cysteine conjugation point variants thereof, which may be the same or different, wherein the cysteine conjugation point variants thereof refers to variants of the peptides comprising conjugation through existing cysteines or through a cysteine residue added to a N- or C-terminus of the peptides; and optionally, 5) 1-8 targeting ligands, solubilizing agents, pharmacokinetics enhancing agents, lipids, and/or masking agents.

4. The modular composition of claim 3, wherein the tetraGalNAc ligands and/or the peptides are attached to the siRNA at different 2'-positions of the ribose rings and/or at different terminal 3' and/or 5'-positions of the siRNA; and wherein the tetraGalNAc ligands and/or the peptides are attached to the siRNA optionally via linkers.

5. The modular composition of claim 3, wherein X of Formula (I), (II) or (III) is —O—, —S— or —CH$_2$—; and n is 1, 2 or 3.

6. The modular composition of claim 3, wherein the composition comprises 1-4 tetraGalNAc ligands, which may be the same or different.

7. The modular composition of claim 3, wherein the composition comprises 1-8 peptides, which may be the same or different.

8. The modular composition of claim 3,
wherein the siRNA is double stranded; and
wherein the tetraGalNAc ligands are attached to the guide strand or the passenger strand of the siRNA at different 2'-positions of the ribose rings of the siRNA.

9. The modular composition of claim 3,
wherein the siRNA is double stranded; and
wherein the tetraGalNAc ligands are attached to the guide strand or the passenger strand of the siRNA at different terminal 3' and/or 5'-positions.

10. The modular composition of claim 3,
wherein the siRNA is double stranded; and
wherein the tetraGalNAc ligands are attached to both the guide strand and the passenger strand of the siRNA at different 2'-positions of the ribose rings and/or different terminal 3' and/or 5'-positions.

11. The modular composition of claim 3,
wherein the siRNA is double stranded; and
wherein the peptides are attached to the guide strand or the passenger strand of the siRNA at different 2'-positions of the ribose rings of the siRNA.

12. The modular composition of claim 3,
wherein the siRNA is double stranded; and
wherein the peptides are attached to the guide strand or the passenger strand of the siRNA at different terminal 3' and/or 5'-positions.

13. The modular composition of claim 3,
wherein the siRNA is double stranded; and
wherein the peptides are attached to both the guide strand and the passenger strand of the siRNA at different 2'-positions of the ribose rings and/or different terminal 3' and/or 5'-positions.

14. The modular composition of claim 3, wherein the tetraGalNAc ligands and the peptides are attached to the same strand of the siRNA.

15. The modular composition of claim 3, wherein the tetraGalNAc ligands and the peptides are attached to different strands of the siRNA.

16. The modular composition of claim 3, wherein the tetraGalNAc ligands and the peptides are attached to the same or different strands of the siRNA via linkers.

17. The modular composition of claim 16, wherein each linker is independently selected from the group consisting of:

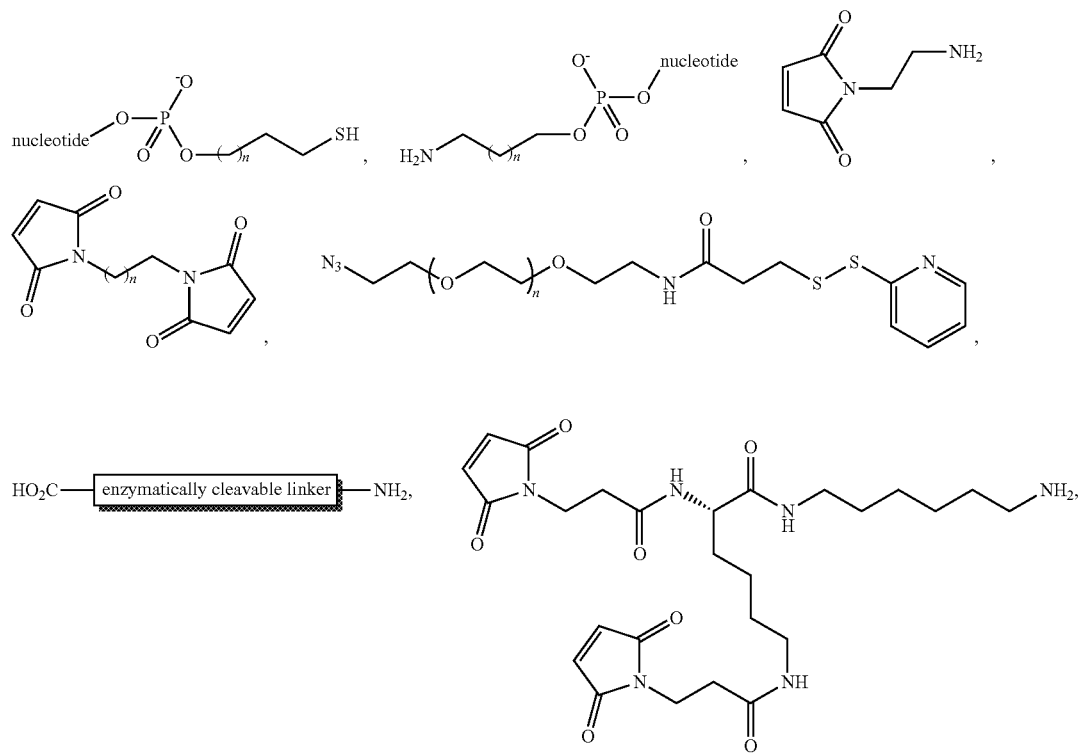

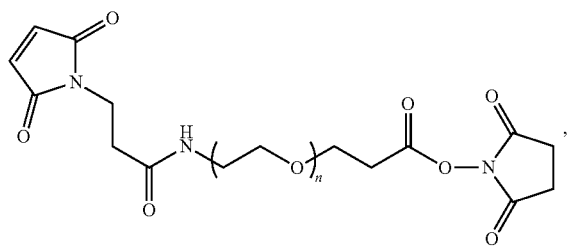
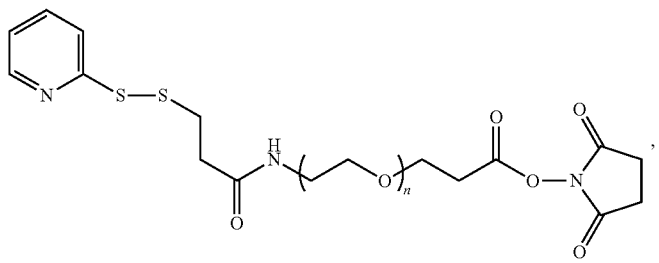
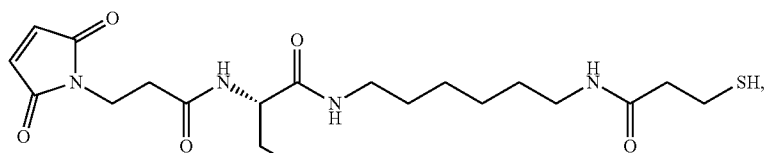
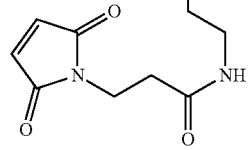
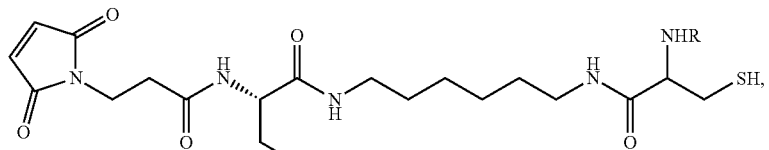
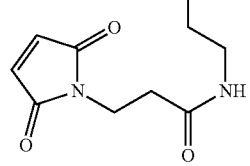
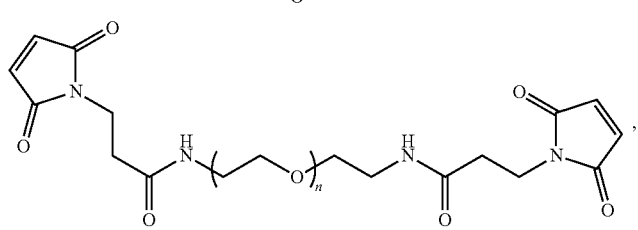
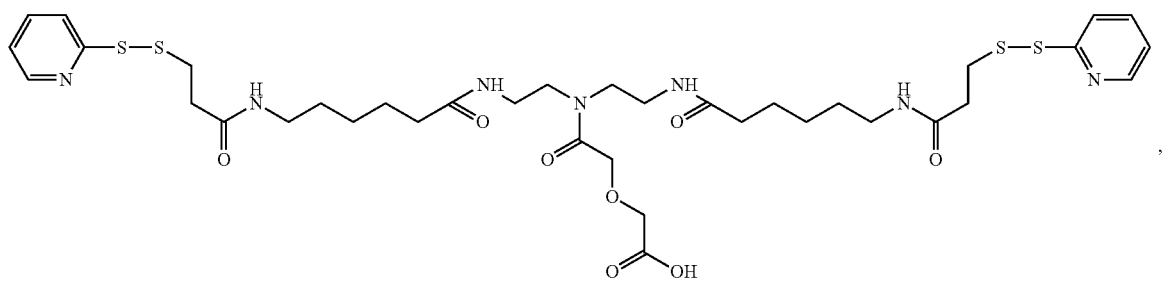

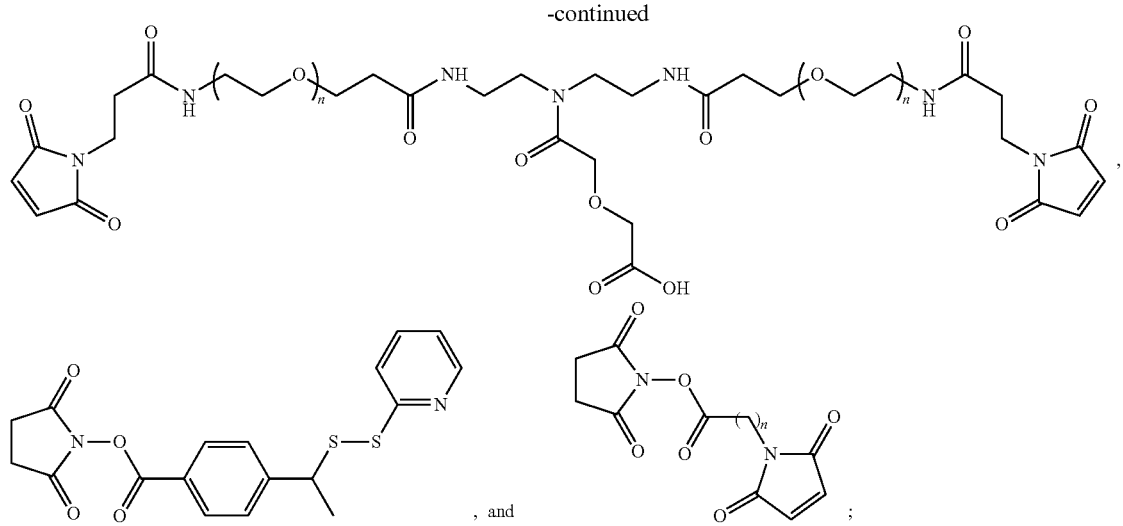
wherein:
each R is independently H, Boc (tert-butyloxycarbonyl), Cbz (carboxybenzyl), Ac (acetyl), a PEG, a lipid, a targeting ligand, linker(s), or peptide(s); and
each n is 0 to 750.
18. The modular composition of claim 16, wherein each linker is independently selected from the group consisting of:
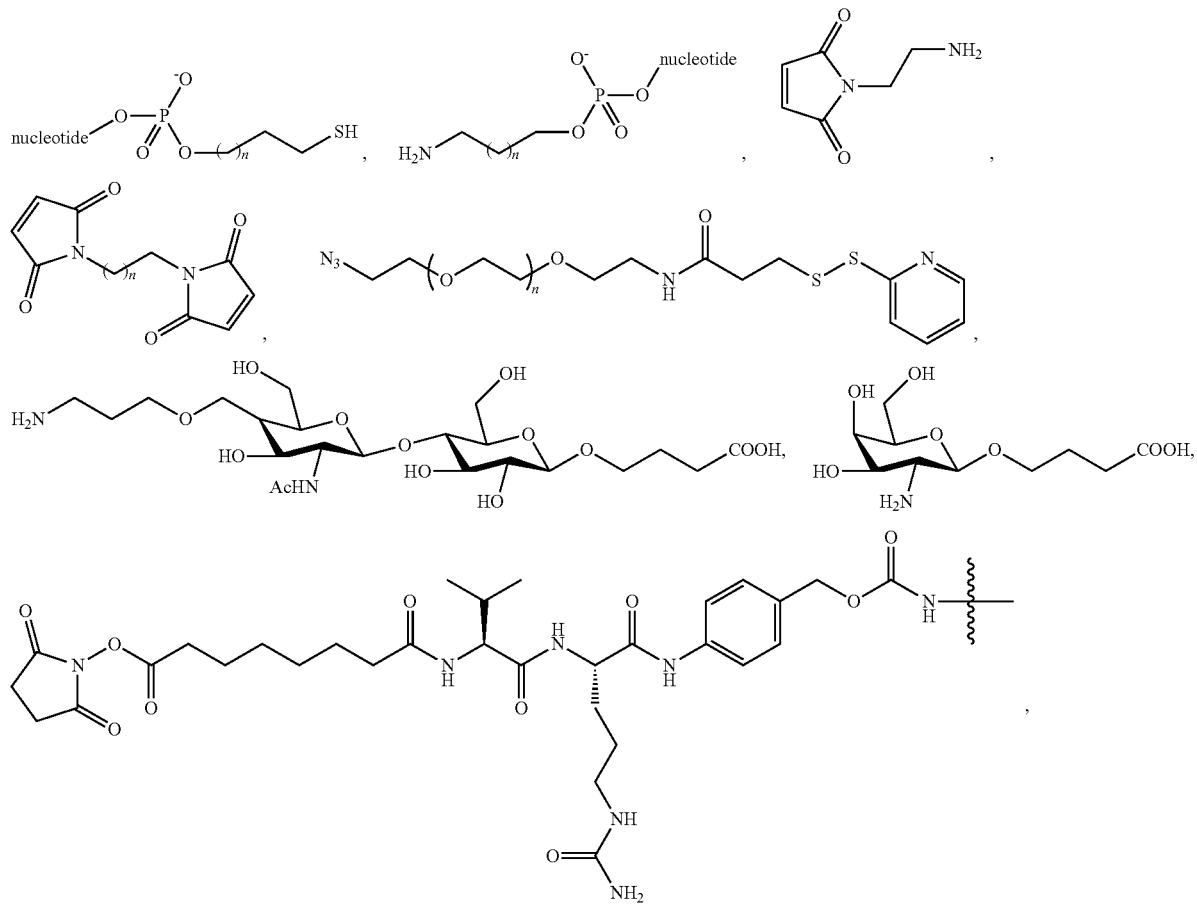

-continued
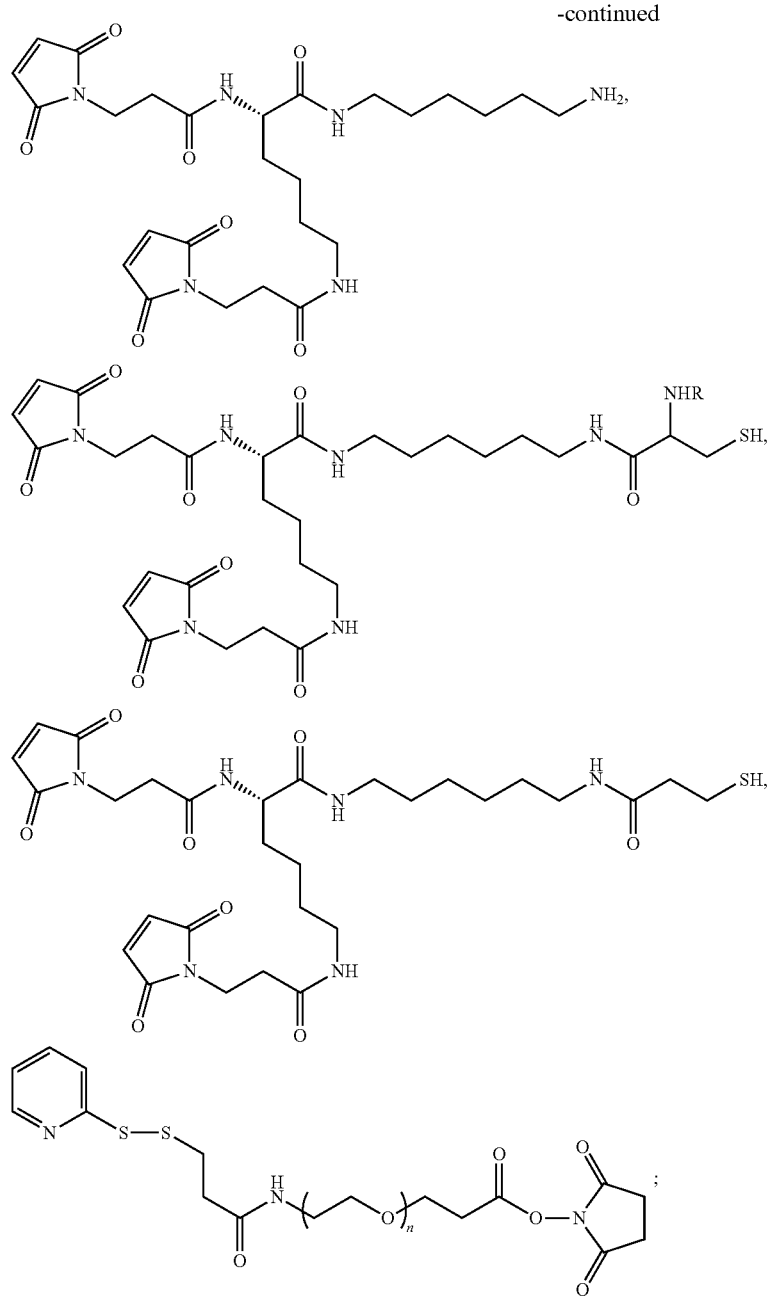
wherein:
each R is independently H, Boc (tert-butyloxycarbonyl), Cbz (carboxybenzyl), Ac (acetyl), a PEG, a lipid, a targeting ligand, linker(s), or peptide(s); and
each n is 0 to 750.
19. The modular composition of claim 18, wherein the linker is a branching linker independently selected from the group consisting of:
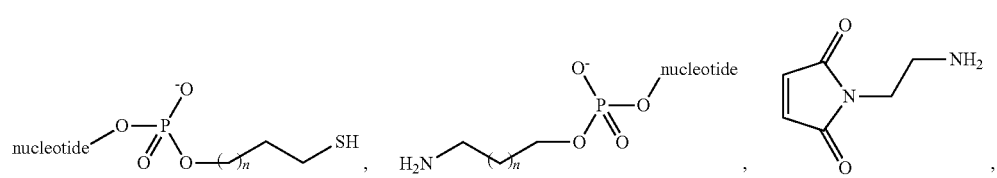

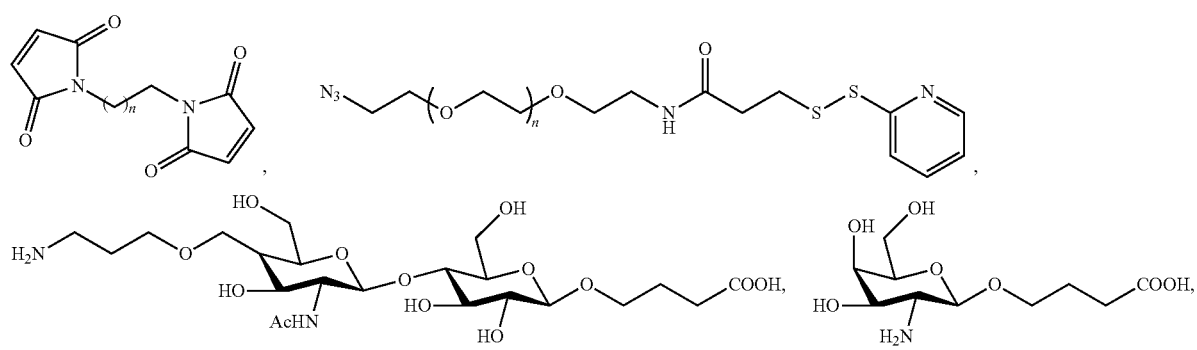
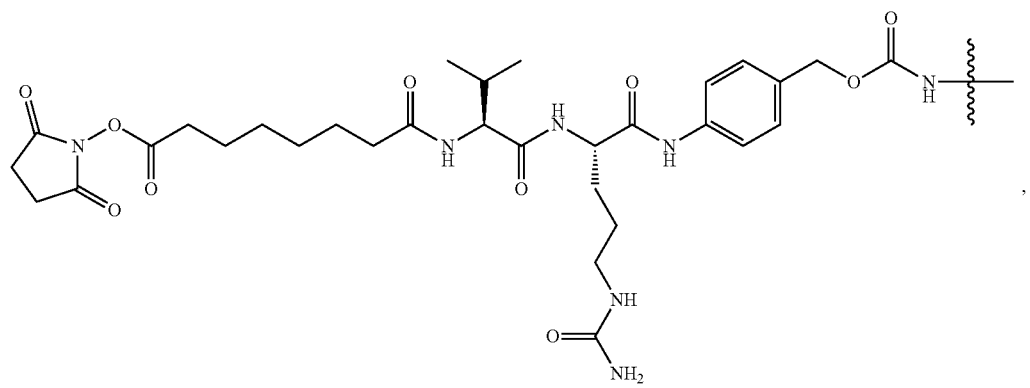
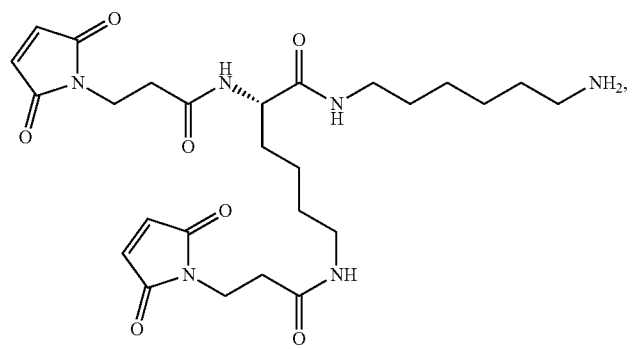
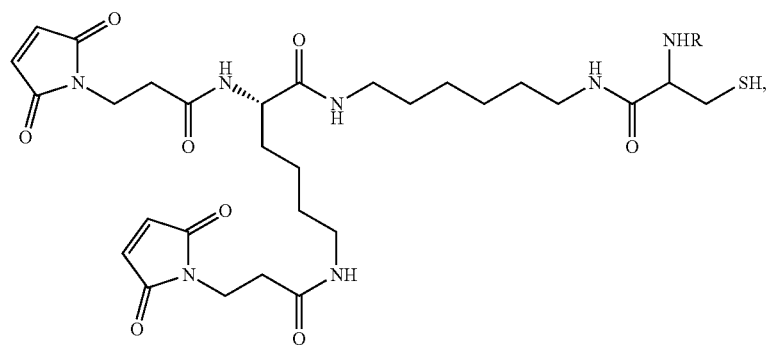

-continued

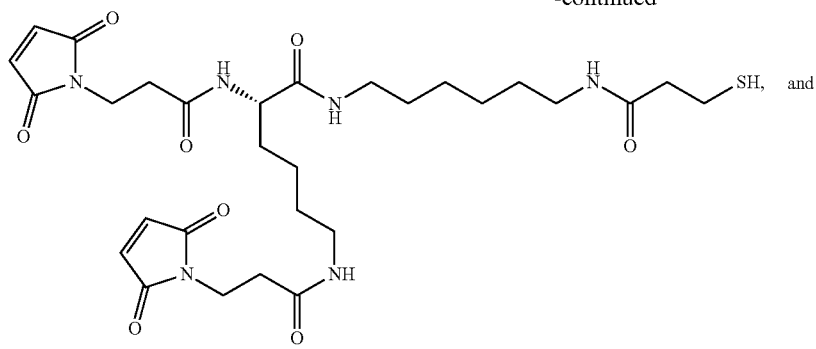

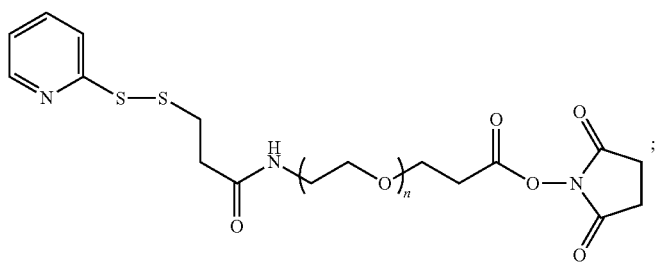

wherein:

each R is independently H, Boc (tert-butyloxycarbonyl), Cbz (carboxybenzyl), Ac (acetyl), a PEG, a lipid, a targeting ligand, linker(s), or peptide(s); and each n is 0 to 750.

20. The modular composition of claim 3, wherein the siRNA is double stranded; and wherein the optional targeting ligands, solubilizing agents, pharmacokinetics enhancing agents, lipids, and/or masking agents are attached to the same or different strands of the siRNA via linkers.

21. A modular composition comprising:

1) a double stranded siRNA;

2) 1-8 tetraGalNAc ligands of Formula (IV), (V) or (VI):

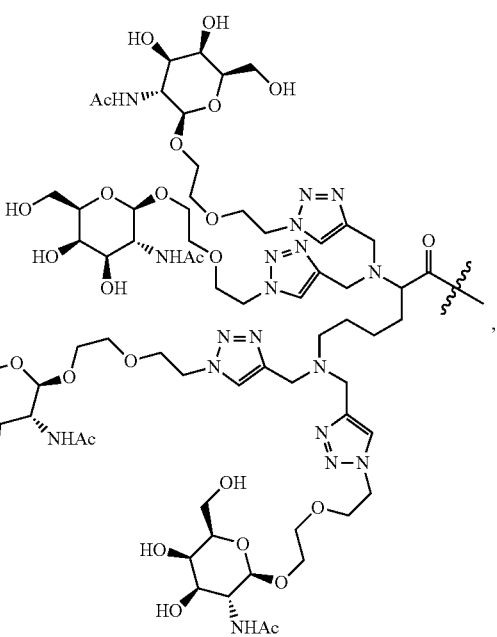

(IV)

-continued

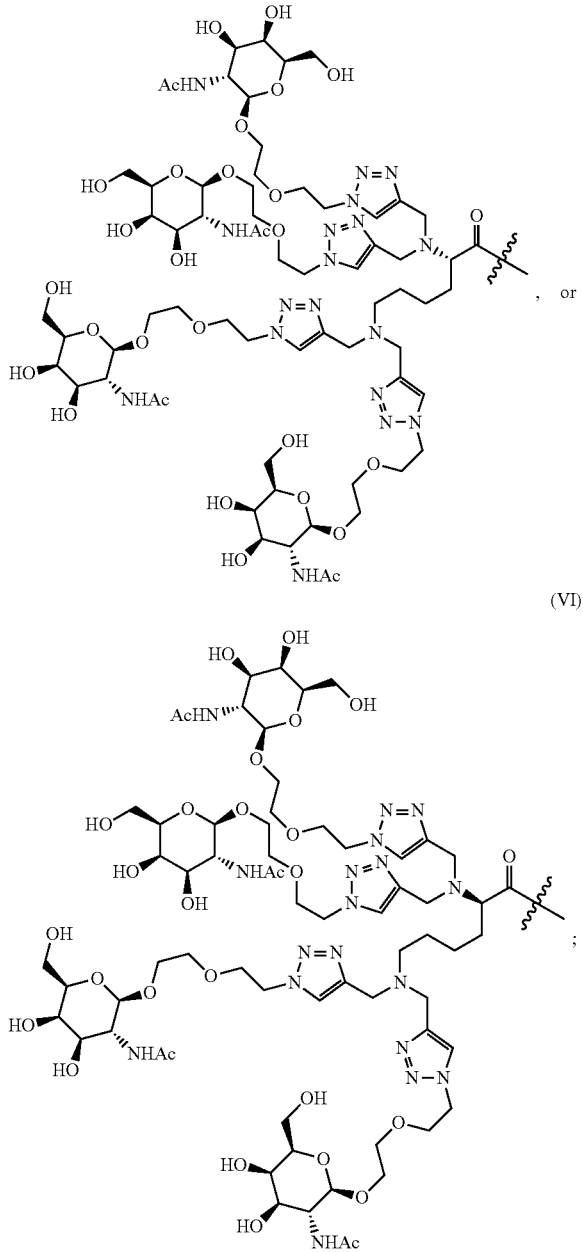

3) 1-24 linkers which may be the same or different;
4) 1-12 peptides independently selected from SEQ ID No. 1-474, or the D-amino acid, retro-inverso, and cysteine conjugation point variants thereof, which may be the same or different, wherein the cysteine conjugation point variants thereof refers to variants of the peptides comprising conjugation through existing cysteines or through a cysteine residue added to a N- or C-terminus of the peptides; and,
optionally, 5) 1-8 targeting ligands, solubilizing agents, pharmacokinetics enhancing agents, lipids, and/or masking agents.

22. The modular composition of claim 21 comprising:
1) a double stranded siRNA;
2) 1-4 tetraGalNAc ligands of Formula (V);
3) 1-12 linkers which may be the same or different;
4) 1-8 peptides independently selected from SEQ ID No. 1-474, or the D-amino acid, retro-inverso, and cysteine conjugation point variants thereof, which may be the same or different, wherein the cysteine conjugation point variants thereof refers to variants of the peptides comprising conjugation through existing cysteines or through a cysteine residue added to a N- or C-terminus of the peptides; and,
optionally, 5) 1-4 targeting ligands, solubilizing agents, pharmacokinetics enhancing agents, lipids, and/or masking agents;
wherein the tetraGalNAc ligands and/or the peptides are attached to the siRNA at different 2'-positions of the ribose rings and/or at different terminal 3' and/or 5'-positions of the siRNA; and
wherein the tetraGalNAc ligands and/or the peptides are attached to the siRNA optionally via linkers.

23. The modular composition of claim 21, wherein the tetraGalNAc ligands and the peptides are attached to the same strand of the siRNA via linkers.

24. The modular composition of claim 21, wherein the tetraGalNAc ligands and the peptides are attached to different strands of the siRNA via linkers.

25. The modular composition of claim 21 comprising:
1) a double stranded siRNA;
2) 1-4 tetraGalNAc ligands of Formula (IV);
3) 1-12 linkers which may be the same or different;
4) 1-8 peptides independently selected from SEQ ID No. 2, 3, 5, 7, 11, 13, 19, 22, 27-32, 55, 56, 63, 64, 69, 71-74, 86, 90, 94, 95, 106, 137, 192, 200, 201, 228, 229, 266, 282, 333, 337, 407, 423, 436, 437, 461-463, 467, 468, 470, 473 and 474, or the D-amino acid, retro-inverso, and cysteine conjugation point variants thereof, which may be the same or different, wherein the cysteine conjugation point variants thereof refers to variants of the peptides comprising conjugation through existing cysteines or through a cysteine residue added to a N- or C-terminus of the peptides; and,
optionally, 5) 1-4 targeting ligands, solubilizing agents, pharmacokinetics enhancing agents, lipids, and/or masking agents;
wherein the tetraGalNAc ligands and/or the peptides are attached to the siRNA at different 2'-positions of the ribose rings and/or at different terminal 3' and/or 5'-positions of the siRNA; and
wherein the tetraGalNAc ligands and/or the peptides are attached to the siRNA via linkers.

26. The modular composition of claim 25 comprising the D-amino acids of the peptides independently selected from SEQ ID No. 2, 3, 5, 7, 11, 13, 19, 22, 27-32, 55, 56, 63, 64, 69, 71-74, 86, 90, 94, 95, 106, 137, 192, 200, 201, 228, 229, 266, 282, 333, 337, 407, 423, 436, 437, 461-463, 467, 468, 470, 473 and 474, which may be the same or different.

27. The modular composition of claim 25, wherein the tetraGalNAc ligands and the peptides are attached to the same or different strands of the siRNA via linkers.

28. The modular composition of claim 25, wherein the tetraGalNAc ligands and the peptides are attached to different strands of the siRNA via linkers.

29. The modular composition of claim 21 comprising:
1) a double stranded siRNA;
2) 1-4 tetraGalNAc ligands of Formula (V);
3) 1-12 linkers which may be the same or different;
4) 1-8 peptides independently selected from SEQ ID No. 2, 3, 5, 7, 11, 13, 19, 22, 27-32, 55, 56, 63, 64, 69, 71-74, 86, 90, 94, 95, 106, 137, 192, 200, 201, 228, 229, 266, 282, 333, 337, 407, 423, 436, 437, 461-463, 467, 468, 470, 473 and 474, or the D-amino acid, retro-inverso, and cysteine conjugation point variants thereof, which may be the same or different, wherein the cysteine conjugation point variants thereof refers to variants of the peptides comprising conjugation through existing cysteines or through a cysteine residue added to a N- or C-terminus of the peptides; and, optionally, 5) 1-4 targeting ligands, solubilizing agents, pharmacokinetics enhancing agents, lipids, and/or masking agents;

wherein the tetraGalNAc ligands and/or the peptides are attached to the siRNA at different 2'-positions of the ribose rings and/or at different terminal 3' and/or 5'-positions of the siRNA; and wherein the tetraGalNAc ligands and/or the peptides are attached to the siRNA via linkers.

30. The modular composition of claim 29, wherein the tetraGalNAc ligands and the peptides are attached to the same or different strands of the siRNA via linkers.

31. The modular composition of claim 29 comprising 1 tetraGalNAc ligand, wherein the tetraGalNAc ligand is attached to the siRNA via a linker.

32. The modular composition of claim 29 comprising 1 peptide, wherein the peptide is attached to the siRNA via a linker.

33. The modular composition of claim 29 comprising 2-4 tetraGalNAc ligands, wherein the tetraGalNAc ligands are attached to the same strand or different strands of the siRNA via linkers.

34. The modular composition of claim 29 comprising 2-4 peptides, wherein the peptides are attached to the same strand or different strands of the siRNA via linkers.

35. A pharmaceutical composition comprising the modular composition of claim 1 and a pharmaceutically acceptable excipient.

* * * * *